US010196695B2

(12) United States Patent
Horn et al.

(10) Patent No.: US 10,196,695 B2
(45) Date of Patent: Feb. 5, 2019

(54) RNA-BIOMARKERS FOR DIAGNOSIS OF PROSTATE CANCER

(71) Applicant: FRAUNHOFER-GESELLSCHAFT ZUR FÖRDERUNG DER ANGEWANDTEN FORSCHUNG E.V., München (DE)

(72) Inventors: Friedemann Horn, Leipzig (DE); Jörg Hackermüller, Leipzig (DE); Sabina Christ, Leipzig (DE); Kristin Reiche, Leipzig (DE); Manfred Wirth, Leipzig (DE); Michael Fröhner, Leipzig (DE); Susanne Füssel, Leipzig (DE)

(73) Assignee: FRAUNHOFER-GESELLSCHAFT ZUR FÖRDERUNG DER ANGEWANDTEN FORSCHUNG, München (CN)

( * ) Notice: Subject to any disclaimer, the term of this patent is extended or adjusted under 35 U.S.C. 154(b) by 0 days.

(21) Appl. No.: 15/100,943

(22) PCT Filed: Dec. 1, 2014

(86) PCT No.: PCT/EP2014/076139

§ 371 (c)(1),
(2) Date: Jun. 1, 2016

(87) PCT Pub. No.: WO2015/082414

PCT Pub. Date: Jun. 11, 2015

(65) Prior Publication Data

US 2016/0304965 A1 Oct. 20, 2016

(30) Foreign Application Priority Data

Dec. 2, 2013 (EP) .................................... 13195377

(51) Int. Cl.
*C12Q 1/68* (2018.01)
*C12Q 1/6886* (2018.01)

(52) U.S. Cl.
CPC ..... *C12Q 1/6886* (2013.01); *C12Q 2600/158* (2013.01)

(58) Field of Classification Search
CPC ........................ C12Q 1/6886; C12Q 2600/158
See application file for complete search history.

(56) References Cited

U.S. PATENT DOCUMENTS

| | | | |
|---|---|---|---|
| 2005/0118625 | A1 | 6/2005 | Mounts |
| 2005/0272080 | A1 | 12/2005 | Palma et al. |
| 2007/0134655 | A1 | 6/2007 | Bentwich |
| 2016/0298199 | A1 | 10/2016 | Horn et al. |
| 2016/0304966 | A1 | 10/2016 | Horn et al. |
| 2016/0304967 | A1 | 10/2016 | Horn et al. |
| 2016/0312291 | A1 | 10/2016 | Horn et al. |

FOREIGN PATENT DOCUMENTS

| | | | | |
|---|---|---|---|---|
| EP | 1572962 | A2 | 9/2005 | |
| EP | 2878678 | A1 | 6/2015 | |
| EP | 3077530 | A1 | 10/2016 | |
| EP | 3077531 | A1 | 10/2016 | |
| EP | 3077535 | A1 | 10/2016 | |
| EP | 3077536 | A1 | 10/2016 | |
| EP | 3077537 | A1 | 10/2016 | |
| WO | WO-01/60860 | A2 | 8/2001 | |
| WO | WO-2004/044123 | A2 | 5/2004 | |
| WO | WO-2005/007830 | A2 | 1/2005 | |
| WO | WO-2006/048291 | A2 | 5/2006 | |
| WO | WO-2012/174256 | A2 | 12/2012 | |
| WO | WO 2013028788 | A1 * | 2/2013 | ........... C12Q 1/6886 |
| WO | WO-2015/082414 | A1 | 6/2015 | |
| WO | WO-2015/082416 | A1 | 6/2015 | |
| WO | WO-2015/082417 | A1 | 6/2015 | |
| WO | WO-2015/082418 | A1 | 6/2015 | |
| WO | WO-2015/082420 | A1 | 6/2015 | |

OTHER PUBLICATIONS

LOC148537; *Homo sapiens* uncharacterized LOC145837 (LOC145837), non-coding RNA; NCBI Reference Sequence: NR_026979.1; https://www.ncbi.nlm.nih.gov/nuccore/224028282?sat=17&satkey=23467833; pp. 1-2, available Jun. 30, 2012.*

LOC145837 mRNA; *Homo sapiens* hypothetical protein LOC145837, mRNA (cDNA clone Image:40022450); Accession # BC104435; https://www.ncbi.nlm.nih.gov/nucleotide/74355860?report=genbank&log$=nucltop&blast_rank=1&RID=TVENGVVZ016; pp. 1-2, available Apr. 10, 2007.*

Database EMBL, TPA: *Homo sapiens* Long Non-Coding RNA OTTHUMT00000322439.1 (AC144450.2 gene), lincRNA. Retrieved from EBI Accession No. EM_STD:HG493488. Database Accession No. HG493488.

Database EMBL, TPA: *Homo sapiens* Long Non-Coding RNA OTTHUMT00000322440.1 (AC144450.1 gene), antisense. Retrieved from EBI Accession No. EM_STD:HG493486. Database Accession No. HG493486.

Database EMBL, TPA: *Homo sapiens* Long Non-coding RNA OTTHUMT00000416816.1 (RP11-279F6.1 gene), lincRNA. XP002736947. Retrieved from EBI Acession No. EM_STD:HG507174. Database Accession No. HG507174 Sequence.

Database EMBL, TPA: *Homo sapiens* Long Non-coding RNA OTTHUMT00000416804.2 (RP11-279F6.1 gene), lincRNA. XP002736946. Retrieved from EBI Acession No. EM_STD:HG507175. Database Accession No. HG507175 Sequence.

Database EMBL, TPA: *Homo sapiens* Long Non-coding RNA OTTHUMT00000416818.1 (RP11-279F6.1 gene), lincRNA. XP002736948. Retrieved from EBI Acession No. EM_STD:HG507177. Database Accession No. HG507177 Sequence.

(Continued)

*Primary Examiner* — Antonio Galisteo Gonzalez
(74) *Attorney, Agent, or Firm* — Ballard Spahr LLP

(57) ABSTRACT

The invention relates to the identification and selection of differentially expressed transcripts (biomarker) in tumour cells. Specific determination of the level of these biomarkers can be used for screening and diagnosis of prostate cancer. Clinical application of assays based on these biomarker help reduce the high number of false positives of current standard screening assays.

3 Claims, 5 Drawing Sheets

Specification includes a Sequence Listing.

(56) References Cited

OTHER PUBLICATIONS

Database EMBL, TPA: *Homo sapiens* Long Non-coding RNA OTTHUMT00000416819.1 (RP11-279F6.1 gene), lincRNA. XP002736949. Retrieved from EBI Acession No. EM_STD:HG507178. Database Accession No. HG507178 Sequence.
Database EMBL, TPA: *Homo sapiens* Long Non-coding RNA OTTHUMT00000416820.1 (RP11-279F6.1 gene), lincRNA. XP002736950. Retrieved from EBI Acession No. EM_STD:HG507179. Database Accession No. HG507179 Seuence.
Database EMBL, TPA: *Homo sapiens* Long Non-coding RNA OTTHUMT00000416805.13 (RP11-279F6.1 gene), lincRNA. XP002736951. Retrieved from EBI Acession No. EM_STD:HG507180. Database Accession No. HG507180 Sequence.
Database EMBL, TPA: *Homo sapiens* Long Non-coding RNA OTTHUMT00000416807.2 (RP11-279F6.1 gene), lincRNA. XP002736952. Retrieved from EBI Acession No. EM_STD:HG507181. Database Accession No. HG507181 Sequence.
Database EMBL, TPA: *Homo sapiens* AC012531.25 Gene (TPA: *Homo sapiens* AC012531.25 Gene for Long Non-coding RNA OTTHUMT00000422086.1), lincRNA; GenBank: HG504812.1; https://www.ncbi.nlm.nih.gov/nuccore/551874401?sat=18&satkey=5358290; pp. 12 (2013).
Fontenete, S. et al., Controversies in Using Urine Samples for Prostate Cancer Detection: PSA and PCA3 Expression Analysis. Int Braz J Urol. 2011; 37(6):719-26.
Gleason, D.F. et al., Histologic Grading and Clinical Staging of Prostate Carcinoma. In M. Tannenbaum (Ed.), Urologic Pathology: The Prostate, Philadelphia: Lea and Febiger. 1977; pp. 171-198.
Gleason, D.F., Histologic Grading of Prostate Cancer: A Perspective. Human Pathol. 1992; 23(3):273-9.
Harrow, J. et al., Gencode: The Reference Human Genome Annotation for the Encode Project. Genome Res. 2012; 22(9):1760-74.
Prensner, J.R. et al., Transcriptome Sequencing Across a Prostate Cancer Cohort Identifies PCAT-1, an Unannotated lincRNA Implicated in Disease Progression. Nat Biotechnol. 2011; 29(8):742-9.
International Search Report and Written Opinion dated Mar. 8, 2015 by the International Searching Authority for Patent Application No. PCT/EP2014/076139, which was filed on Dec. 1, 2014 and published as WO 2015/082414 on Jun. 11, 2015 (Inventor—Horn et al.; Applicant—Fraunhofer-Gesellschaft Zur Förderung Der Angewandten Forschung E.V.) (11 pages).
Preliminary Report on Patentability dated Jun. 7, 2016 by the International Searching Authority for Patent Application No. PCT/EP2014/076139, which was filed on Dec. 1, 2014 and published as WO 2015/082414 on Jun. 11, 2015 (Inventor—Horn et al.; Applicant—Fraunhofer-Gesellschaft Zur Förderung Der Angewandten Forschung E.V.) (6 pages).
International Search Report and Written Opinion dated Mar. 25, 2015 by the International Searching Authority for Patent Application No. PCT/EP2014/076141, which was filed on Dec. 1, 2014 and published as WO 2015/082416 on Jun. 11, 2015 (Inventor—Horn et al.; Applicant—Fraunhofer-Gesellschaft Zur Förderung der Angewandten Forschung E.V.) (8 pages).
International Preliminary Report on Patentability dated Jun. 7, 2016 by the International Searching Authority for Patent Application No. PCT/EP2014/076141, which was filed on Dec. 1, 2014 and published as WO 2015/082416 on Jun. 11, 2015 (Inventor—Horn et al.; Applicant—Fraunhofer-Gesellschaft Zur Förderung der Angewandten Forschung E.V.) (4 pages).
International Search Report dated Apr. 15, 2015 by the International Searching Authority for Patent Application No. PCT/EP2014/076145, which was filed on Dec. 1, 2014 and published as WO 2015/082418 on Jun. 11, 2015 (Inventor—Horn et al.; Applicant—Fraunhofer-Gesellschaft Zur Förderung der Angewandten Forschung E.V.) (10 pages).
International Preliminary Report on Patentability dated Jun. 7, 2016 by the International Searching Authority for Patent Application No. PCT/EP2014/076145, which was filed on Dec. 1, 2014 and published as WO 2015/082418 on Jun. 11, 2015(Inventor—Horn et al.; Applicant—Fraunhofer-Gesellschaft Zur Förderung der Angewandten Forschung E.V.) (6 pages).
International Search Report and Written Opinion dated Mar. 20, 2015 by the International Searching Authority for Patent Application No. PCT/EP2014/076147, which was filed on Dec. 1, 2014 and published as WO 2015/082420 on Jun. 11, 2015 (Inventor—Horn et al.; Applicant—Fraunhofer-Gesellschaft Zur Förderung Der Angewandten Forschung E.V.) (8 pages).
Preliminary Report on Patentability dated Jun. 7, 2016 by the International Searching Authority for Patent Application No. PCT/EP2014/076147, which was filed on Dec. 1, 2014 and published as WO 2015/082420 on Jun. 11, 2015 (Inventor—Horn et al.; Applicant—Fraunhofer-Gesellschaft Zur Förderung Der Angewandten Forschung E.V.) (4 pages).
European Search Report and Written Opinion dated Aug. 21, 2014 by the European Patent Office for Patent Application No. 13195377, which was filed on Dec. 2, 2013 and published as EP 2878678 on Jun. 3, 2015 (Inventor—Horn et al.; Applicant—Fraunhofer-Gesellschaft Zur Förderung Der Angewandten Forschung E.V.) (7 pages).
Communication Pursuant to Article 94(3) EPC dated Spetember 29, 2017 by the European Patent Office for Patent Application No. 14835550, which was filed on Dec. 1, 2014 and published as EP 3077537 on Oct. 12, 2016 (Inventor—Horn et al.; Applicant—Fraunhofer-Gesellschaft Zur Förderung Der Angewandten Forschung E.V.) (3 pages).
Communication Pursuant to Article 94(3) EPC dated Jul. 27, 2017 by the European Patent Office for Patent Application No. 14833341.2, which was filed on Dec. 1, 2014 and published as EP 3077535 on Oct. 12, 2016 (Inventor—Horn et al.; Applicant—Fraunhofer-Gesellschaft Zur Förderung Der Angewandten Forschung E.V.) (3 pages).
Communication Pursuant to Article 94(3) EPC dated Jul. 28, 2017 by the European Patent Office for Patent Application No. 14835474.9, which was filed on Dec. 1, 2014 and published as EP 3077536 on Oct. 12, 2016 (Inventor—Horn et al.; Applicant—Fraunhofer-Gesellschaft Zur Förderung Der Angewandten Forschung E.V.) (4 pages).
Communication Pursuant to Article 94(3) EPC dated Jul. 28, 2017 by the European Patent Office for Patent Application No. 14825105.1, which was filed on Dec. 1, 2014 and published as EP 3077530 on Oct. 12, 2016 (Inventor—Horn et al.; Applicant—Fraunhofer-Gesellschaft Zur Förderung Der Angewandten Forschung E.V.) (6 pages).
Communication Pursuant to Article 94(3) EPC dated Sep. 18, 2017 by the European Patent Office for Patent Application No. 14825106.9, which was filed on Apr. 15, 2015 and published as EP3077531 on Oct. 12, 2016 (Inventor—Horn et al.; Applicant—Fraunhofer-Gesellschaft Zur Förderung der Angewandten Forschung E.V.) (3 pages).
LOC283177; *Homo sapiens* Uncharacterized LOC283177, Non-coding RNA; NCBI References Sequence: NR_033852; https://www.ncbi.nlm.nih.gov/nuccore/299782566?sat=17&satkey=23661116; pp. 1-3 (2012).
AC144450; *Homo sapiens* Fosmid Clone XXFOS-8097D7 from 2, Complete Sequence; AC144450.2;http://www.ncbi.nlm.nih.gov/nucleotide/30231399?report=genbank&log$=nucltop&blast_rank=2&RID=1SHYF96E015; pp. 1-6 (2005).
Preliminary Amendment was filed on Jun. 1, 2016 with the U.S. Patent and Trademark Office for U.S. Appl. No. 15/100,949, filed Jun. 1, 2016 and published as US 2016/0312291 on Oct. 27, 2016 (Inventor—Horn et al.; Applicant—Fraunhofer-Gesellschaft Zur Förderung der Angewandten Forschung E.V.) (6 pages).
Restriction Requirement dated Jan. 13, 2017 by with the U.S. Patent and Trademark Office for U.S. Appl. No. 15/100,949, filed Jun. 1, 2016 and published as US 2016/0312291 on Oct. 27, 2016 (Inventor—Horn et al.; Applicant—Fraunhofer-Gesellschaft Zur Förderung der Angewandten Forschung E.V.) (9 pages).
Response to Restriction Requirement was filed on Mar. 13, 2017 to with the U.S. Patent and Trademark Office for U.S. Appl. No. 15/100,949, filed Jun. 1, 2016 and published as US 2016/0312291

(56) References Cited

OTHER PUBLICATIONS on Oct. 27, 2016 (Inventor—Horn et al.; Applicant—Fraunhofer-Gesellschaft Zur Förderung der Angewandten Forschung E.V.) (9 pages).
Non Final Rejection dated Mar. 30, 2017 by with the U.S. Patent and Trademark Office for U.S. Appl. No. 15/100,949, filed Jun. 1, 2016 and published as US 2016/0312291 on Oct. 27, 2016 (Inventor—Horn et al.; Applicant—Fraunhofer-Gesellschaft Zur Förderung der Angewandten Forschung E.V.) (11 pages).
Response to Non Final Rejection was filed on Jun. 29, 2017 to with the U.S. Patent and Trademark Office for U.S. Appl. No. 15/100,949, filed Jun. 1, 2016 and published as US 2016/0312291 on Oct. 27, 2016 (Inventor—Horn et al.; Applicant—Fraunhofer-Gesellschaft Zur Förderung der Angewandten Forschung E.V.) (18 pages).
Final Rejection dated Sep. 29, 2017 by the U.S. Patent and Trademark Office for U.S. Appl. No. 15/100,949, filed Jun. 1, 2016 and published as US 2016/0312291 on Oct. 27, 2016 (Inventor—Horn et al.; Applicant—Fraunhofer-Gesellschaft Zur Förderung der Angewandten Forschung E.V.) (10 pages).
Response to Final Office Action filed on Dec. 6, 2017 by the U.S. Patent and Trademark Office for U.S. Appl. No. 15/100,949, filed Jun. 1, 2016 and published as US 2016/0312291 on Oct. 27, 2016 (Inventor—Horn et al.; Applicant—Fraunhofer-Gesellschaft Zur Förderung der Angewandten Forschung E.V.) (10 pages).
Advisory Action dated Dec. 18, 2017 by the U.S. Patent and Trademark Office for U.S. Appl. No. 15/100,949, filed Jun. 1, 2016 and published as US 2016/0312291 on Oct. 27, 2016 (Inventor—Horn et al.; Applicant—Fraunhofer-Gesellschaft Zur Förderung der Angewandten Forschung E.V.) (3 pages).
Non-Final Office Action dated Dec. 28, 2017 by the U.S. Patent and Trademark Office for U.S. Appl. No. 15/100,949, filed Jun. 1, 2016 and published as US 2016/0312291 on Oct. 27, 2016 (Inventor—Horn et al.; Applicant—Fraunhofer-Gesellschaft Zur Förderung der Angewandten Forschung E.V.) (10 pages).
Preliminary Amendment filed on Jun. 2, 2016 with the U.S. Patent and Trademark Office for U.S. Appl. No. 15/101,150, filed Jun. 2, 2016 and published as US 2016/0304967 on Oct. 20, 2016 (Inventor—Horn et al.; Applicant—Fraunhofer-Gesellschaft Zur Förderung der Angewandten Forschung E.V.) (3 pages).
Restriction Requirement dated Jan. 17, 2017 by the U.S. Patent and Trademark Office for U.S. Appl. No. 15/101,150, filed Jun. 2, 2016 and published as US 2016/0304967 on Oct. 20, 2016 (Inventor—Horn et al.; Applicant—Fraunhofer-Gesellschaft Zur Förderung der Angewandten Forschung E.V.) (9 pages).
Response to Restriction Requirement filed on May 16, 2017 with the U.S. Patent and Trademark Office for U.S. Appl. No. 15/101,150, filed Jun. 2, 2016 and published as US 2016/0304967 on Oct. 20, 2016 (Inventor—Horn et al.; Applicant—Fraunhofer-Gesellschaft Zur Förderung der Angewandten Forschung E.V.) (7 pages).
Non-Final Office Action dated Jun. 2, 2017 by the U.S. Patent and Trademark Office for U.S. Appl. No. 15/101,150, filed Jun. 2, 2016 and published as US 2016/0304967 on Oct. 20, 2016 (Inventor—Horn et al.; Applicant—Fraunhofer-Gesellschaft Zur Förderung der Angewandten Forschung E.V.) (10 pages).
Response to Non-Final Office Action filed on Dec. 1, 2017 with the U.S. Patent and Trademark Office for U.S. Appl. No. 15/101,150, filed Jun. 2, 2016 and published as US 2016/0304967 on Oct. 20, 2016 (Inventor—Horn et al.; Applicant—Fraunhofer-Gesellschaft Zur Förderung der Angewandten Forschung E.V.) (12 pages).
Final Office Action dated Jan. 25, 2018 by the U.S. Patent and Trademark Office for U.S. Appl. No. 15/101,150, filed Jun. 2, 2016 and published as US 2016/0304967 on Oct. 20, 2016 (Inventor—Horn et al.; Applicant—Fraunhofer-Gesellschaft Zur Förderung der Angewandten Forschung E.V.) (10 pages).
Preliminary Amendment was filed on Jun. 1, 2016 with the U.S. Patent and Trademark Office for U.S. Appl. No. 15/100,952, filed Jun. 1, 2016 and published as US 2016/0304966 on Oct. 20, 2016 (Inventor—Horn et al.; Applicant—Fraunhofer-Gesellschaft Zur Förderung der Angewandten Forschung E.V.) (7 pages).
Restriction Requirement dated Dec. 1, 2017 by the U.S. Patent and Trademark Office for U.S. Appl. No. 15/100,952, filed Jun. 1, 2016 and published as US 2016/0304966 on Oct. 20, 2016 (Inventor—Horn et al.; Applicant—Fraunhofer-Gesellschaft Zur Förderung der Angewandten Forschung E.V.) (9 pages).
Preliminary Amendment was filed on Jun. 1, 2016 with the U.S. Patent and Trademark Office for U.S. Appl. No. 15/100,954, filed Jun. 1, 2016 and published as US 2016/0298199 on Oct. 13, 2016 (Inventor—Horn et al.; Applicant—Fraunhofer-Gesellschaft Zur Förderung der Angewandten Forschung E.V.) (9 pages).
Notice of Abandonment dated Jun. 12, 2017 by the U.S. Patent and Trademark Office for U.S. Appl. No. 15/100,954, filed Jun. 1, 2016 and published as US 2016/0298199 on Oct. 13, 2016 (Inventor—Horn et al.; Applicant—Fraunhofer-Gesellschaft Zur Förderung der Angewandten Forschung E.V.) (2 pages).

* cited by examiner

Microarray analysis of SEQ ID NO 4-10:
A) Box plots

B) ROC curve

RNA-BIOMARKERS FOR DIAGNOSIS OF PROSTATE CANCER

CROSS REFERENCE TO RELATED APPLICATIONS

This application is a national phase filing of International Patent Application No. PCT/EP2014/076139, filed Dec. 1, 2014, which claims priority to European Application No. 13195377.0, filed on Dec. 2, 2013, both of which are herein incorporated by reference in their entireties.

FIELD OF THE INVENTION

The present invention is in the field of biology and chemistry. In particular, the invention is in the field of molecular biology. More particularly, the invention relates to the analysis of RNA transcripts. Most particularly, the invention is in the field of diagnosing prostate cancer.

BACKGROUND

Prostate cancer is the most frequently diagnosed cancer in men. In 2012, the annual number of newly diagnosed prostate cancer cases was reported as approximately 240,000 cases in the United States and approximately 360,000 in the European Union, 68,000 of which in Germany. In the United States, lifetime risks for prostate cancer diagnosis and for dying of prostate cancer are currently estimated at 15.9% and 2.8%, respectively. Despite widespread screening for prostate cancer and major advances in the treatment of metastatic disease, prostate cancer remains the second most common cause of cancer death for men with over 250,000 deaths each year in the Western world.

Currently, testing of prostate-specific antigen (PSA) serum levels and the digital rectal examination represent the two major screening methods. Patients showing abnormal results usually are advised to have a prostate biopsy performed. This has however significant consequences. The lack of specificity of PSA screening which produces high numbers of false positives results in unnecessary prostate biopsies performed annually on millions of men worldwide (overdiagnosis). In addition, taking biopsies carries a substantial risk for infectious complications. Therefore, there is an urgent need for a more sensitive and specific diagnostic assay for early prostate cancer diagnosis to improve prostate cancer screening and to avoid the high numbers of unnecessarily taken prostate biopsies. The present invention addresses this problem by providing a set of biomarkers for the screening and diagnosis of prostate cancer.

SUMMARY OF THE INVENTION

Transcripts differentially expressed in tumour and control tissues were identified by Next Generation Sequencing of 64 samples of prostate cancer patients and controls and validated by microarray and qRT-PCR analyses of 256 and 56 samples, respectively The invention describes RNA biomarkers, which had not so far been found to be suitable for use in the diagnosis of prostate cancer.

The invention relates to a method for the diagnosis of prostate cancer comprising the steps of analysing the expression level of a nucleic acid selected from the group of SEQ ID NO: 1 to 42, wherein, if at least one of said nucleic acids is present and/or the expression level of at least one of said nucleic acids is above a threshold value, the sample is designated as prostate cancer positive.

In a preferred embodiment, the invention relates to a method for the diagnosis of prostate cancer comprising the steps of analysing in a sample from a patient the expression level of a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, wherein, if the expression level of said nucleic acid is above a threshold value, the sample is designated as prostate cancer positive.

In one embodiment, the invention relates to a primer or probe that hybridizes under stringent conditions to a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, or any part thereof.

The invention also relates to the use of a primer or probe that hybridizes under stringent conditions to a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10 for the diagnosis of prostate cancer.

The invention relates to a probe or primer, wherein the probe or primer is specific for a sequence of the group of SEQ ID NO: 1 to 42, preferably for a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10.

The invention relates to a nucleic acid with a sequence from the group of SEQ ID NO: 1 to 42, or the reverse complement thereof, or a nucleic acid that shares preferably at least 85%, 90%, 95% or 99% sequence identity with a nucleic acid according to any one of the nucleic acids according to SEQ ID NO: 1 to 42.

In a preferred embodiment, the invention relates to a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, or the reverse complement thereof, or a nucleic acid that shares preferably at least 85%, 90%, 95% or 99% sequence identity with the selected nucleic acid.

The invention relates to the use of a nucleic acid with a sequence from the group of SEQ ID NO: 1 to 42 for the diagnosis of prostate cancer.

In a preferred embodiment, the invention relates to the use of a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, for the diagnosis of cancer.

The invention also relates to a kit for the diagnosis of prostate cancer comprising a primer or probe that hybridizes under stringent conditions to a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, and reagents for nucleic acid amplification and/or quantification and/or detection.

DEFINITIONS

Figure 1:
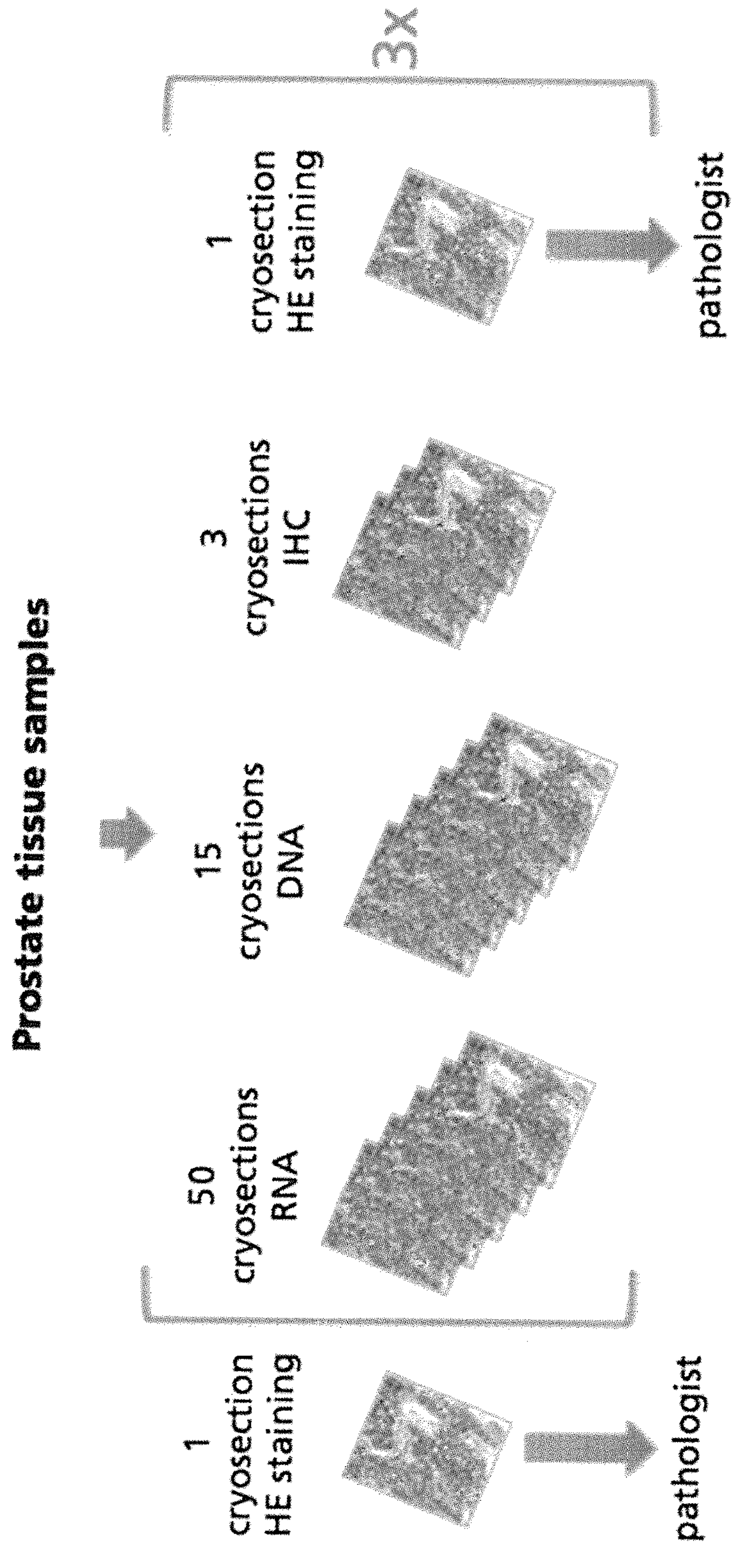
FIG. 1: Verification of tissue sample quality: to determine the tumour cell content of the tissue samples, cryosections were prepared from the frozen samples as shown. HE: hematoxylin/eosin; IHC: immunohistochemistry. Verification of tissue sample quality: cryosections of 4~m were prepared from the frozen samples as shown for HE staining (to ensure tumour cell content of the tissue samples), for RNA and DNA isolation and for IHC. HE: hematoxylin/eosin; IHC: immunohistochemistry.

The following definitions are provided for specific terms, which are used in the application text.

As used herein, "nucleic acid(s)" or "nucleic acid molecule" generally refers to any ribonucleic acid or deoxyribonucleic acid, which may be unmodified or modified. "Nucleic acids" include, without limitation, single- and double-stranded nucleic acids. As used herein, the term "nucleic acid(s)" also includes nucleic acids as described above that contain one or more modified bases. Thus, a nucleic acid with one or several backbone modifications for stability or for other reasons is a "nucleic acid". The term "nucleic acids" as it is used herein encompasses such chemically, enzymatically or metabolically modified forms of nucleic acids, as well as the chemical forms of nucleic acids characteristic of viruses and cells, including for example, simple and complex cells.

The terms "level" or "expression level" in the context of the present invention relate to the level at which a biomarker is present in a sample from a patient. The expression level of a biomarker is generally measured by comparing its expression level to the expression level of one or several housekeeping genes in a sample for normalisation. The sample from the patient is designated as prostate cancer positive if the expression level of the biomarker exceeds the expression level of the same biomarker in an appropriate control (for example a healthy tissue) by a set threshold value.

The term, "analysing a sample for the presence and/or level of nucleic acids" or "specifically estimate levels of nucleic acids", as used herein, relates to the means and methods useful for assessing and quantifying the levels of nucleic acids. One useful method is for instance quantitative reverse transcription PCR. Likewise, the level of RNA can also be analysed for example by northern blot, next generation sequencing or after amplification by using spectrometric techniques that include measuring the absorbance at 260 and 280 nm.

As used herein, the term "amplified", when applied to a nucleic acid sequence, refers to a process whereby one or more copies of a particular nucleic acid sequence is generated from a nucleic acid template sequence, preferably by the method of polymerase chain reaction. Other methods of amplification include, but are not limited to, ligase chain reaction (LCR), polynucleotide-specific based amplification (NSBA), or any other method known in the art.

The term "correlating", as used herein in reference to the use of diagnostic and prognostic marker(s), refers to comparing the presence or amount of the marker(s) in a sample from a patient to its presence or expression level in a sample from a person known to suffer from, or is at risk of suffering from, a given condition. A marker expression level in a patient sample can be compared to a level known to be associated with a specific diagnosis.

As used herein, the term "diagnosis" refers to the identification of the disease, in this case prostate cancer, at any stage of its development, and also includes the determination of predisposition of a subject to develop the disease.

The term "Ensembl gene ID ENSG00000245750.3" relates to a gene ID sequence annotation by Ensembl. Transcripts that belong to the same gene ID may differ in splice events, exons, and can give rise to very different proteins. These are isoforms, arising from alternative splicing. The Ensembl gene ID has several equivalents in other annotation systems such as for example RP11-279F6.1, or locus (hg19) Chr15: 69,755,365-69,863,775 (+). Any equivalent to this Ensembl annotation can be used in its place.

The term "splice variant" refers to the product of an alternative splicing event. Alternative splicing events include exon skipping or inclusion, alternative 5' or 3' splice site usage, or intron retention.

As used herein, the term "fluorescent dye" refers to any chemical that absorbs light energy of a specific wavelength and re-emits light at a different wavelength. Fluorescent dyes suitable for labelling nucleic acids include for example FAM (5- or 6-carboxyfluorescein), VIC, NED, Fluorescein, FITC, IRD-700/800, CY3, CY5, CY3.5, CY5.5, HEX, TET, TAMRA, JOE, ROX, BODIPY TMR, Oregon Green, Rhodamine Green, Rhodamine Red, Texas Red, Yakima Yellow, Alexa Fluor, PET and the like.

As used herein, "isolated" when used in reference to a nucleic acid means that a naturally occurring sequence has been removed from its normal cellular (e.g. chromosomal) environment or is synthesised in a non-natural environment (e.g. artificially synthesised). Thus, an "isolated" sequence may be in a cell-free solution or placed in a different cellular environment.

As used herein, a "kit" is a packaged combination optionally including instructions for use of the combination and/or other reactions and components for such use. If the kit contains nucleic acids, the kit may also comprise synthetic or non-natural variants of said nucleic acids. A synthetic or non-natural nucleic acid is to be understood as a nucleic acid comprising any chemical, biochemical or biological modification, such that the nucleic acid does not appear in nature in this form. Such modifications include, but are not limited to, labelling with a fluorescent dye or a quencher moiety, a biotin tag, as well as modification(s) in the backbone of a nucleic acid, or any other modification that distinguishes the nucleic acid from its natural counterpart. The same applies also to other natural compounds such as proteins, lipids and the like.

The term "patient" as used herein refers to a living human or non-human organism that is receiving medical care or that should receive medical care due to a disease, or is suspected of having a disease. This includes persons with no defined illness who are being investigated for signs of pathology. Thus the methods and assays described herein are applicable to both, human and veterinary disease.

The term "primer" as used herein, refers to an nucleic acid, whether occurring naturally as in a purified restriction digest or produced synthetically, which is capable of acting as a point of initiation of synthesis when placed under conditions in which synthesis of a primer extension product, which is complementary to a nucleic acid strand, is induced, i.e., in the presence of nucleotides and an inducing agent such as a DNA polymerase and at a suitable temperature and pH. The primer may be either single-stranded or double-stranded and must be sufficiently long to prime the synthesis of the desired extension product in the presence of the inducing agent. The exact length of the primer will depend upon many factors, including temperature, source of primer and the method used. Preferably, primers have a length of from about 15-100 bases, more preferably about 20-50, most preferably about 20-40 bases. The factors involved in determining the appropriate length of primer are readily known to one of ordinary skill in the art. Optionally, the primer can be a synthetic element, in the sense that it comprises a chemical, biochemical or biological modification.

Such modifications include, but are not limited to, labelling with a fluorescent dye or a quencher moiety, or a modification in the backbone of a nucleic acid, or any other modification that distinguishes the primer from its natural nucleic acid counterpart.

The term "probe" refers to any element that can be used to specifically detect a biological entity, such as a nucleic acid, a protein or a lipid. Besides the portion of the probe that allows it to specifically bind to the biological entity, the probe also comprises at least one modification that allows its detection in an assay. Such modifications include, but are not limited to labels such as fluorescent dyes, a specifically introduced radioactive element, or a biotin tag. The probe can also comprise a modification in its structure, such as a locked nucleic acid.

The term "sample" as used herein refers to a sample of bodily fluid or tissue obtained for the purpose of diagnosis, prognosis, or evaluation of a subject of interest, such as a patient. Preferred test samples include blood, serum, plasma, cerebrospinal fluid, urine, saliva, sputum, and pleural effusions. In addition, one of skill in the art would realize that some test samples would be more readily analysed following a fractionation or purification procedure, for example, separation of whole blood into serum or plasma components.

Thus, in a preferred embodiment of the invention the sample is selected from the group comprising a blood sample, a serum sample, a plasma sample, a cerebrospinal fluid sample, a saliva sample and a urine sample or an extract of any of the aforementioned samples as well as circulating tumour cells in blood or lymph, any tissue suspected to contain metastases as well as any source that may contain prostate tumour cells or parts thereof, including vesicles like exosomes, microvesicles, and others as well as free or protein-bound RNA molecules derived from prostate tumour cells. Preferably, the sample is a blood sample, most preferably a serum sample or a plasma sample. Importantly, urine (particularly after digital rectal examination) and ejaculate belong to the most preferable samples. Tissue samples may also be biopsy material or tissue samples obtained during surgery.

The term "area under the curve (AUC)" as used herein describes the area under the curve of a receiver operating characteristic (ROC) or ROC curve. The AUC relates to how specific and sensitive a biomarker is. A perfect marker (AUC=1.0) would yield a point in the upper left corner or coordinate (0,1) of the ROC space, representing 100% sensitivity (no false negatives) and 100% specificity (no false positives).

The term "p-value" relate to the probability of obtaining the observed sample results (or a more extreme result) when the null hypothesis is actually true, i.e. there are no differences between means for groups. The smaller the p-value, the higher the likelihood that the alternative hypothesis explains the observed results better than the null hypothesis.

The term "adjusted p-value" refers to p-values which have been adjusted for multiple comparisons (number of genes/probes tested). The method applied is detailed in the experimental section.

DETAILED DESCRIPTION OF THE INVENTION

The invention describes a method of diagnosis of prostate cancer. This method comprises analysing a sample taken from a patient and specifically determining the level of a biomarker or a combination of biomarkers in said patient sample. The result is then correlated to a threshold value and in the case where it is above that threshold value, said patient sample is designated as prostate cancer positive.

The invention relates to a group of sequences comprising SEQ ID NOs 1 to 42. The sequences are listed below. Due to space constraints, only the first 100 nucleotides are listed. The remaining part of the sequence can be found in the sequence protocol.

There are two types of sequences. First, some transcripts are known sequences that are already annotated in relevant databases. They are identified by their respective annotations. Second, new transcripts were identified that are not yet annotated. They are designated here as follows: XLOC_ followed by a number. These designations provide information about the genomic origins of the transcripts, but may not necessarily represent the whole sequence of a given transcript. The sequences as detected may in some cases be longer or shorter. In the case of XLOC transcripts, if fragments are detected, these fragments may be as small as 1000, 500, 400, 300, 200, 150, 100, 50, 40, 30, 20, 10, 9, 8, 7, 6 or 5 nucleotides.

TABLE 1

List of SEQ ID NOs.

| SEQ ID | Transcript | Gene/transcript annotation | Sequence |
|---|---|---|---|
| 1 | 1 | Retro-RPL7 Ensemble-ID gene: ENSG00000242899.1 Locus (hg19): Chr3: 131,962,301-131,963,125 (-) Ensemble-ID transcript(s): ENST00000479738.1 | Ttttccggctggaacc atggagggtgttgaag agaagaagaaggttcc tgctgtgccagaaacc cttaagaaaaagtgaa ggaatttcacagagct gaag |
| 2 | 2 | XLOC 133897 Ensemble-ID gene: none Locus (hg19): chr20: 45,377,600-45,380,719 (-) Ensemble-ID transcript(s): none Includes GenBank entries: AK128800.1, BC065739.1 | gcccgcttctgtgact ccacccccttacggaaa gtctatgggactctct gaaatgtatgagtgat actgttagaaagcggc aagaaaatgaaaagaa aacg |
| 3 | 3 | AC144450.2 Ensemble-ID gene: ENSG00000203635.2 Locus (hg19): Chr2: 1,624,282-1,629,191 (-) Ensemble-ID transcript(s): ENST00000366424 | attgcccacagccgga tccacggtgactaatc tccgggaaggcgtcca gcgtgagccgtgaggc ctgcacctgcgccgga cttcaccactcaccag gagt |
| 4 | 4 | RP11-279F6.1 Ensemble-ID gene: ENSG00000245750.3 Locus (hg19): Chr15: 69,755,365-69,863,775 (+) Ensemble ID trancript: ENST00000558633 | caggaatgggctgggg cgcgtttgtagttggg aatcctgagcccgggc tgttgcttggaggact cgggagcagcagtgga tttcggcgttaccagg agag |
| 5 | 4 | ENST00000558309 | ttcggcgttaccagga gagctatgtataggaa tgccgctatggaaaga catccaggacaccttg ttaagtgaaaaaagac atgccaccattagggc ttca |
| 6 | 4 | ENST00000560882 | gaggcccgacattgtg ctggggaaggagctcc agaaagggccatcctt tctgttttggttcagt atctgaacacttttgc taaaggtctctggaaa gctc |

TABLE 1-continued

List of SEQ ID NOs.

| SEQ ID | Transcript | Gene/transcript annotation | Sequence |
|---|---|---|---|
| 7 | 4 | ENST00000559029 | Gactggagaggccagc acgcacagtgacttaa tccaagaagatggaat aaAaaggcctacctca ttgggctcgtgtgggt gaggagaactgaagag tctg |
| 8 | 4 | ENST00000558781 | Ctgggcttccagcttc caagccttctacctgt ggaatgcttggtccaa tgTctggggcacccac tcttactccaaactcc tccagatctgcagagt ggcc |
| 9 | 4 | ENST00000498938 | Ggagctggttccagga aagaagggcacatgag caaacatgatggcccc tttatgagaggtaatt tactgaaatgcacagc gattacctgctcaccc agcc |
| 10 | 4 | ENST00000559477 | aggaacttggaataac ttgcagtgtcttgcag tattgtgaaaccagca acTtgttcacaattct tctgaatttcttggga aatttgaagtggagta cctg |
| 11 | 5 | AC144450.1 Ensemble-ID gene: ENSG00000228613.1 Locus (hg19): Chr2: 1,550,437-1,623,885 (-) Ensemble-ID transcript(s): ENST00000438247.1 | cagttttcacaggcct gtgtgccgagagtgtt ccttaccatttttca ttattattctgctaag gaggattttagacat tatgttcctagtcaag ccct |
| 12 | 6 | AC012531.25 Ensemble-ID gene: ENSG00000260597.1 Locus (hg19): Chr12: 54,413,694-54,416,373 (+) Ensemble-ID transcript(s): ENST00000562848.1 | caagacagaggcaagc agagaaggcatagcag cagcgaccggcgctct gttttcattttccact ctggccaggggataaa ctggaccccagtggac tcca |
| 13 | 7 | XLOC_068574 Ensemble-ID gene: none Locus (hg19): chr14: 62,653,302-62,655,723 (+30) Ensemble-ID transcript(s): none | ggtaacatgaaaataa tggatgagcagttcaa ctatattaaaaataaa cgtggttaagagtgct caccttaagtgtagga tttgaaagtgtaggct ctaa |
| 14 | 8 | RP1-207H1.3 Ensemble-ID gene: ENSG00000231150.1 Locus (hg19): chr6: 38,890,805-38,920,875 (-) Ensemble ID transcript: ENST00000416948.1 | Tgaagcccatgagcca ctagaagccacatgtt ctgccatgtggagaag aatgagagagtacatc ctcaaattgaggtgtg gcatgatgatttggct gccc |

TABLE 1-continued

List of SEQ ID NOs.

| SEQ ID | Trans-cript | Gene/transcript annotation | Sequence |
|---|---|---|---|
| 15 | 8 | ENST00000453417.1 | ctttcaagggcctgtgcctgtggtaactgtctatgagccaggtatatctgaagcatatttgacaacagaaaaagttaatgtaattttcaaaggaaaaacg |
| 16 | 8 | ENST00000418399.1 | atatctgaagcatatttgacaacagaaaaagttaatgtaattttcaaaggaaaaacgccaacttttttcaaaaaggaaacagcaactggagagcagattt |
| 17 | 9 | XLOC_016724 Ensemble-ID gene: none Locus (hg19): chr1: 177,827,793-177,841,757 (-) | atcccctctgagaatttatcagaaaaacaagcaataagtgagaccaacgttgtgaggtattaactcggaaccgtcatctatccttgtggagaaaaacccg |
| 18 | 10 | RP11-314013.1 Ensemble-ID gene: ENSG00000260896 Locus (hg19): Chr16: 80,862,632-80,926,492 (-) Ensemble ID transcript: ENST00000562231 | ttctttttgtttgctgccttccgtagaagatgtggcttgctcatgcttgacttctgccatggttgtgaggcctccccagccatgtggaactgttttcagg |
| 19 | 10 | ENST00000569356 | AggggtttccgcttttgcttcttcctcattttctcttgctgctgccatttTcgcctcccgccatgattctgaggcctccccagctatgtggaactgtaag |
| 20 | 10 | ENST00000561519 | AaaagactatctcttcccattgaattaaattggaactttggaatcttaatAgaaaaccaactgacttggcttggttttcaggtgctggttccatggctct |
| 21 | 10 | ENST00000563626 | CttgctcatgcttgacttctgccatggttgtgaggcctccccagccatgtGgaactgttttcaggtgctggttccatggctcttcctgagccgaaaataa |
| 22 | 11 | XLOC_167596 Ensemble-ID gene: none Locus (hg19): chr4: 67,964,836-67,975,652 (-) | Ctctttctctccttctcccttccttcctccctccctccctctcttcctctcttttctttctttctttctctttctttctttcttctttctttctttctttcttt |
| 23 | 12 | XLOC_167595 Ensemble-ID gene: Locus (hg19): chr4: 67,946,236-67,964,614 (-) | aaacatacgtgtgcatgtgtctttatggcagcatgatttataatcctttggggatatactcagtaatgggatggctgggtcaaatggtatttctagttct |
| 24 | 13 | XLOC_156132 Ensemble-ID gene: none Locus (hg19): chr3: 193,632,725-193,636,178 (-) | agtatgtgcatttgtaccttgctttgttttcctcaactttgtgcttgtttCtgtaattccctcattcattcctacctctgcatgcttgaaagttctttgt |
| 25 | 14 | XLOC_156120 Ensemble-ID gene: none Locus (hg19): chr3: 193,580,748-193,608,459 (-) | accaaaggacatgcgaaaacttttgggtgtgatggatatagtcataatctttattgtggtgactgtttcacacatgtgtacatatatcacaactcatcaa |
| 26 | 15 | RP11-627G23.1 Ensemble-ID gene: ENSG00000255545.3 Locus (hg19): Chr11: 134,306,367-134,375,555 (+) Ensemble ID transcript: ENST00000533390 | cttcctcggggtttgcttccaggcctgactttactcccctttctaagtgtgcagatgggatgtgcttctccacaggaggccccacggcttccccacccc |
| 27 | 15 | ENST00000531319 | ctgtctcaagcctccaatcaacagatcagacagcttgtactcacaggccaaggacacgtggaaagaggctcaattttctagatgggtggcaacagccatg |
| 28 | 15 | ENST00000528482 | gaggcagccatgactggccacttcatgtgctcctggagaagggcttgcaccagccgttttcaggaaagtcaagcagctgttgactcctgagtctgggtga |
| 29 | 15 | ENST00000532886 | caaatgcctggcagcgtcctcggtgcttcacctgccatagccgacagtggctgacctcccatgcctgttgccttttctttctgttggatcagggatacac |
| 30 | 16 | XLOC_047797 Ensemble-ID gene: none Locus (hg19): chr12: 75,378,181-75,383,176 (+) | aagatgggacaattttttttcctcttggtttctttataattattgtacccctttctggaataatcttttcatcttgttcatctgtcaatgcctgcttgt |
| 31 | 17 | ANKRD34B Ensemble-ID gene: ENSG00000189127.3 Locus (hg19): Chr5: 79,852,574-79,866,307 (-) Ensemble ID transcript: ENST00000338682 | agctgctggccccccctgggtccagaggagcctgccgccctcacctgcgcagagcctggagccgacgcgtcacccccagcggaagcgcctcgctgcccgg |
| 32 | 17 | ENST00000508916 | agctcagctcagacggcgccctagggccgcacagagggtcgggcagtgccggagagaggtttgaaagcgccgccgccaactcgacagcgcgtcccaggaa |

TABLE 1-continued

List of SEQ ID NOs.

| SEQ ID | Transcript | Gene/transcript annotation | Sequence |
| --- | --- | --- | --- |
| 33 | 18 | XLOC_243739 Ensemble-ID gene: none Locus (hg19): chr9: 79,530,077-79,542,427 (-) | aaacaggaaaagaaat tgggattttttatgaaa aatgttaaaggctagc tctgttaggatttccc atgacattgcagtggt gacatggtcgtggatg tgcc |
| 34 | 19 | XLOC_198292 Ensemble-ID gene: none Locus (hg19): chr6: 148,396,831-148,428,362 (+) | tccctcccttccttcc ttccttccttcctttc ttcccttcagtttctc ttccttctaatgcccc ctgtccttaaaaatgt ctcccattcaggcacta tgca |
| 35 | 20 | XLOC_068639 Ensemble-ID gene: none Locus (hg19): chr14: 62,931,844-62,933,233 (+) | ccaagatttctcatcc atggtttcaactaaga atattttattctctcc agtgaaatttttttaca attaggattgcaaaac tacatacattcaggta gatc |
| 36 | 21 | XLOC_172083 Ensemble-ID gene: none Locus (hg19): chr4: 169,961,616-169,999,957 (-) | cactgcagtctctccc tccctggttcaagcaa ttctcttgcctcagtc tcctgagtagctggga ccacaggcgctcacca ccacgcatggctcatt tttg |
| 37 | 22 | XLOC_172082 Ensemble-ID gene: none Locus (hg19): chr4: 169,947,628-169,961,481 (-) | agtgatccgcccgcct ccgcctcccaaagtgc tgggattacaggtgtg agccactgcgcctggc cgctgctcttatacta ttttgaatgtaggccg gccg |
| 38 | 23 | XLOC_112832 Ensemble-ID gene: none Locus (hg19): chr2: 123,297,707-123,644,538 (+) | agcagatggcatttga gcaaacacttgcaaaa ggtgaggaagatagcc atcatagctgatggaa caagcaaaacaaaagt cataaggaagaattgt actc |
| 39 | 24 | XLOC_243747 Ensemble-ID gene: none Locus (hg19): chr9: 79,622,778-79,633,361 (-) | cccgcagctgcgcccc acccgggccaccaagc acggtggagggggaac aggacactgccttctt gcttctcttctctctg gcatctccctcttccg cccc |
| 40 | 25 | XLOC_243744 Ensemble-ID gene: none Locus (hg19): chr9: 79,601,892-79,606,132 (-) | atgtgccaccacacct ggctgattttttgtat ttttagtagagatggg atatcaccatattaac caagatggtctcgatt acctgacctcgtgatc cgcc |
| 41 | 26 | XLOC_126289 Ensemble-ID gene: none Locus (hg19): chr2: 180,988,687-180,989,287 (-) | cctgtgcatctaattt agtgggggcagacct gtttcacaagccaaaa taacaggctgcaataa ctgaggatttatata taccctgaccaaagaa gttt |
| 42 | 27 | XLOC_172084 Ensemble-ID gene: none Locus (hg19): chr4: 169,983,995-169,984,246 (-) | attgtggaactgctct ttctccctgcgattca gaggggaaaagataaa gccacacagccctggg gcctcttgcttaagaa cacatctcagtttaac cacc |

SEQ ID NOs 1 to 42 are listed together with the corresponding transcript and gene annotations. The first 100 nucleotides of each SEQ ID NO are shown.

Figure 2:
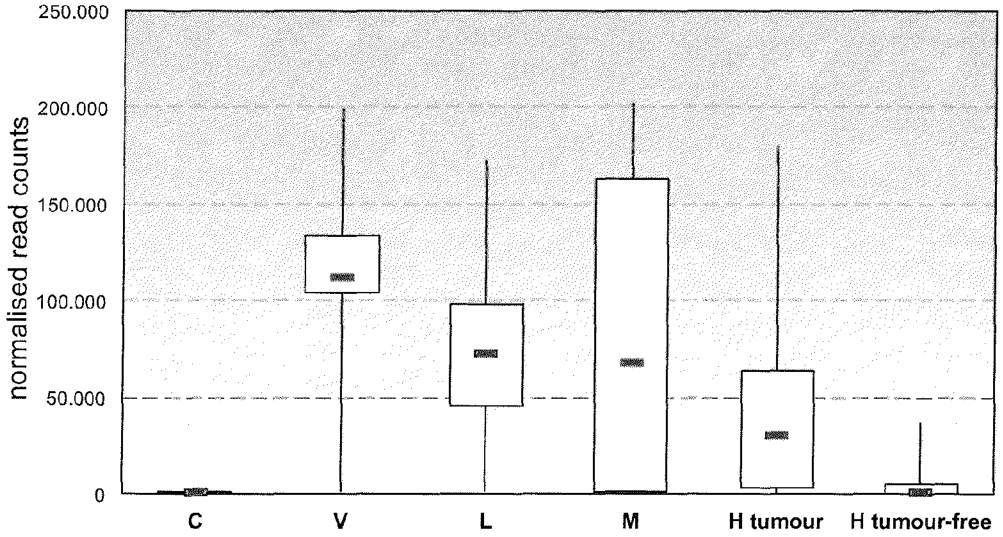
FIG. 2: Box plot of RNA-seq data for transcript PCA3. Results from RNA sequencing of the retrospective PCa cohort comprising 8 prostate tissue samples from benign prostate hyperplasia as a control (C), 8 PCa tumour samples each of groups V (very low risk; Gleason score <7, pNO), L (low risk; Gleason score =7, pNO), and M (medium risk; Gleason score <=7, pN+), as well as 16 pairs of tumour and tumour-free tissue samples from group H (high risk; Gleason score >7).

The biomarker PCA3 is routinely used for prostate carcinoma (PCa) diagnosis. As expected therefore, PCA3 expression levels were indicative of PCa in the subjects tested by next generation sequencing by the inventors (FIG. 2). However, it was found that the biomarker had its highest expression level in very low risk tumours (V) and decreased as the risk factor of tumours grew. This finding makes PCA3 an unreliable marker for medium- and high-risk tumours and shows the need for better prostate cancer biomarkers.

Figure 3:
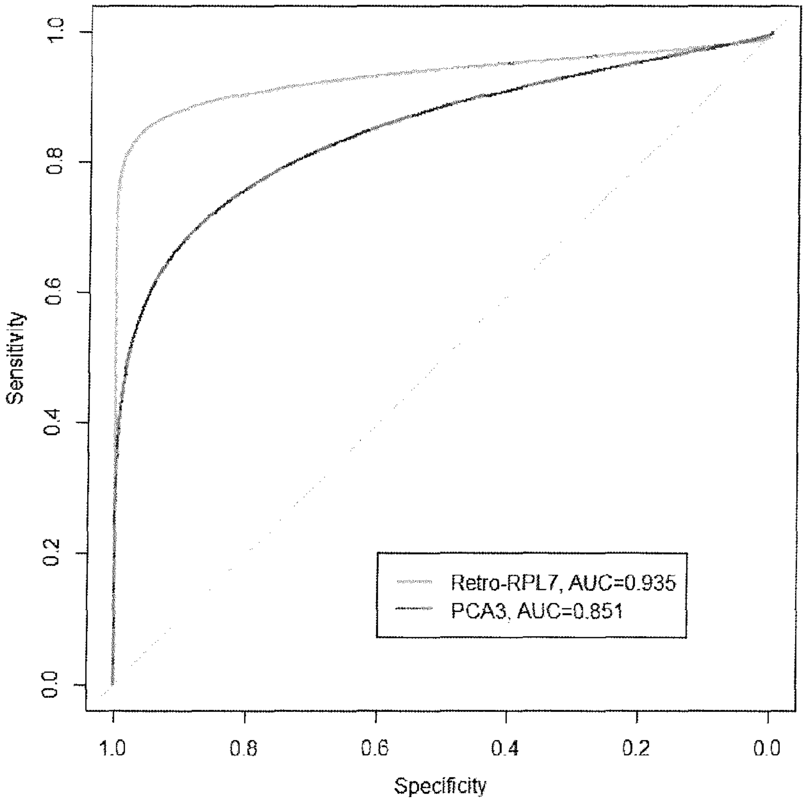
FIG. 3: ROC curves of Retro-RPL7 (SEQ ID NO 1) and PCA3 obtained by qRT-PCR analysis of 56 prostate tissue samples.

Many of the novel biomarkers found by the inventors are significantly better in terms of specificity and sensitivity than PCA3. Retro-RPL7 (SEQ ID NO: 1) for example yielded an area under the ROC curve (AUC) value of 0.935, compared to 0.851 for PCA3 (FIG. 3).

Figure 4:
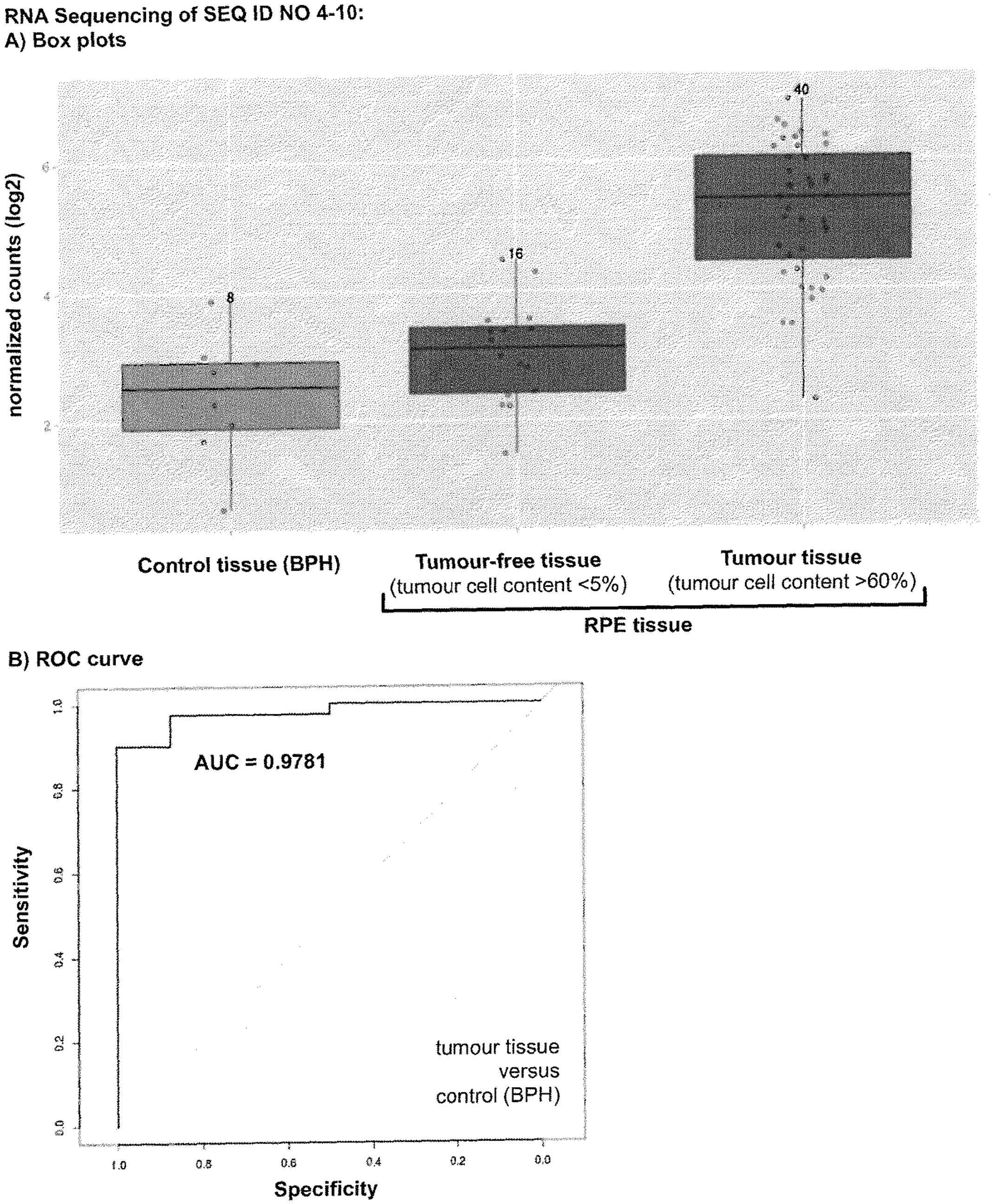
FIG. 4: RNA Next-Generation Sequencing data for SEQ ID NO:4 to 10 from 64 tissue samples. 8 control tissue samples originated from patients with benign prostate hyperplasia (BPH) and 56 tissue samples were obtained from patients with prostate cancer upon radical prostatectomy (RPE). Amongst the latter, 40 samples represented tumour tissue containing a tumour cell count of at least 60% whereas 16 samples represented adjacent tumour-free tissue (tumour cell count of max. 5%) derived from the same patients. (A) Box plot showing the normalised counts for the nucleic acid with SEQ ID NO: 4 to 10. (B) ROC curve of the comparison of nucleic acid with SEQ ID NO: 4 to 10 expression levels between tumour and control samples: Area under the ROC curve (AUC): 0.978.
Figure 5:
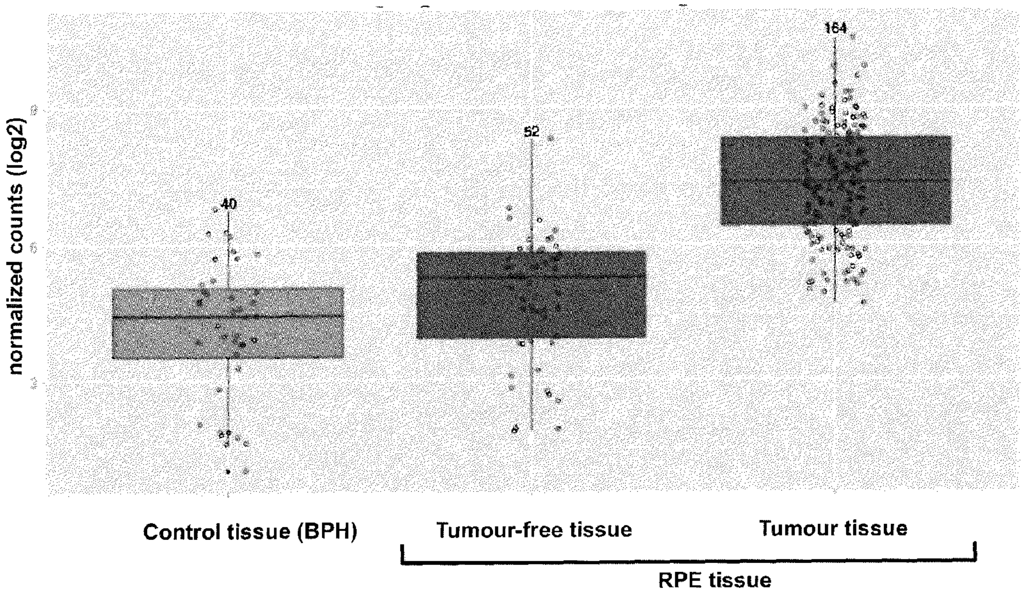
FIG. 5: Custom microarray data for SEQ ID NO:4 to 10 from 256 tissue samples. control tissue samples originated from patients with benign prostate hyperplasia (BPH) and 216 tissue samples were obtained from patients with prostate cancer upon radical prostatectomy (RPE). Amongst the latter, 164 samples represented tumour tissue whereas 52 samples represented adjacent tumour-free tissue derived from the same patients. (A) Box plot showing the normalised counts for the nucleic acid with SEQ ID NO: 4 to 10. (B) ROC curve of the comparison of nucleic acid with SEQ ID NO: 4 to 10 expression levels between tumour and control samples: Area under the ROC curve (AUC): 0.9591.
Figure 5:
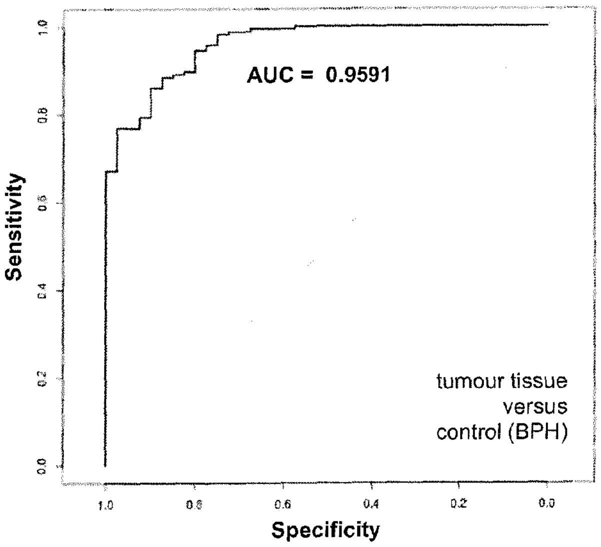

The novel biomarker corresponding to a splice variant of Ensembl gene ID ENSG00000245750.3 selected from the group consisting of SEQ ID NO: 4, SEQ ID NO: 5, SEQ ID NO: 6, SEQ ID NO: 7, SEQ ID NO: 8, SEQ ID NO: 9 and SEQ ID NO: 10, was also found to be highly differentially expressed between patients with tumours and control patients as shown in FIG. 4. The area under the ROC curve for this biomarker in the sequencing experiment is 0.978. The differential expression of SEQ ID NOs: 4 to 10 could be validated by custom array analysis of 256 tissue samples (FIG. 5).

Hence the invention relates to a method for the diagnosis of prostate cancer comprising the steps of analysing the expression level of the nucleic acid according to SEQ ID NO: 1 to 42, wherein, if at least one of said nucleic acids is present and/or the expression level of at least one of said nucleic acids is above a threshold value, the sample is designated as prostate cancer positive.

In a preferred embodiment, the invention relates to a method for the diagnosis of prostate cancer comprising the steps of analysing in a sample from a patient the expression level of a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, wherein, if the expression level of said nucleic acid is above a threshold value, the sample is designated as prostate cancer positive.

In a more preferred embodiment, the invention relates to a method for the diagnosis of prostate cancer comprising the steps of analysing in a sample from a patient the expression level of a splice variant of Ensembl gene ID ENSG00000245750.3 selected from the group consisting of SEQ ID NO: 4, SEQ ID NO: 5, SEQ ID NO: 6, SEQ ID NO: 7, SEQ ID NO: 8, SEQ ID NO: 9 and SEQ ID NO: 10, wherein, if the expression level of said nucleic acid is above a threshold value, the sample is designated as prostate cancer positive.

In an alternative embodiment, analysing the expression level of a nucleic acid means analysing the reverse complement or the cDNA of the nucleic acid.

In a preferred embodiment, the sample is selected from the group comprising prostate tissue, biopsy material, lymph nodes, urine, ejaculate, blood, blood serum, blood plasma, circulating tumour cells in blood or lymph, any tissue suspected of containing metastases as well as any source that may contain prostate tumour cells or parts thereof, including vesicles like exosomes, micro vesicles, and others as well as free or protein-bound RNA molecules derived from prostate tumour cells or parts thereof. More preferably, the sample is urine, and most preferably, the sample is urine obtained from a patient after a digital rectal examination.

The experimental results demonstrate high specificity and sensitivity of the novel biomarkers for the detection of PCa.

Ideally, the expression level of a transcript of the nucleic acids according to SEQ ID NO: 1 to 42, more preferably a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, is compared to the expression level of one or several other gene transcripts in the sample, such as of housekeeping genes.

Examples of suitable housekeeping genes are shown below in Table 2:

TABLE 2

| Examples of suitable housekeeping genes<br>Housekeeping gene name |
|---|
| GAPDH - Glyceraldehyde 3-phosphate dehydrogenase |
| HPRT1 - hypoxanthine phosphoribosyltransferase 1 |
| HMBS - hydroxymethylbilane synthase |
| TBP Tata box binding protein |

The threshold value is the minimal expression difference between the test sample and the control sample at which the sample is designated as cancer-positive.

Ideally the threshold value for the biomarker expression level difference between the test sample and the control sample is 1.5 fold (±20%), 2 fold (±20%), 3 fold(±20%), 4 fold (±20%) and most preferably 5 fold (±20%) or more. The p-value (T test) is $<2\times10^{-5}$. The FDR is preferably $<5\times10^{-4}$.

For a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10 the threshold is preferably a 2 fold expression level increase between the test sample and the control sample to designate a sample as prostate cancer positive.

The invention is concerned with the quantification of the expression level of RNA biomarkers. After amplification, quantification is straightforward and can be accomplished by a number of methods. In the case when primers are used wherein at least one primer has a fluorescent dye attached, quantification is possible using the fluorescent signal from the dye. Various primer systems and dyes are available, such as SYBR green, Multiplex probes, TaqMan probes, molecular beacons and Scorpion primers. These are suitable for instance to carry out PCR-based methods such as quantitative reverse transcription PCR (qRT-PCR). Other possible means of quantification are for example northern blotting, next generation sequencing or absorbance measurements at 260 and 280 nm.

Any suitable method for the quantification of nucleic acids may be used to analyse the expression levels of the nucleic acids. In one embodiment of the invention, the analysis in the method is performed by a fluorescence based assay. In a preferred embodiment, the analysis is done by measuring the fluorescence of a labelled primer, labelled probe or a fluorescent detection agent (such as SYBR green). More preferably, this analysis of the expression level is performed by qRT-PCR. In this method, after reverse transcription, the sample is mixed with a forward and a reverse primer specific for at least one nucleic acid selected from the group of SEQ ID NO: 1 to 42, preferably a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, followed by amplification. Probes or primers are designed such that they hybridize under stringent conditions to said target sequence.

In one embodiment, the analysis of the expression level is performed by next generation sequencing.

In an alternative embodiment, the protein product of one of SEQ ID NO: 1 to 42, preferably SEQ ID NO: 4 to 10, is analysed and/or quantified.

The invention also relates to a primer or probe that hybridizes under stringent conditions to one of the nucleic acids according to SEQ ID NO: 1 to 42.

In a preferred embodiment, the invention relates to a primer or probe that hybridizes under stringent conditions to a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, or any part thereof, wherein said primer or a probe is preferably a labelled probe.

In a preferred embodiment of the invention, the primer or probe that hybridizes under stringent conditions to a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, is about 5 to 500 nt in length, more preferably, 10 to 200 nt, even more preferably 10 to 100 nt. In the most preferred embodiment, said nucleic acid is 5, 6, 7, 8, 9, 10, 11, 12, 13, 14, 15, 16, 17, 18, 19, 20, 21, 22, 23, 24, 25, 26, 27, 28, 29 or 30 nt in length.

In one embodiment of the invention, the primer or probe that hybridizes under stringent conditions to a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, comprises a detectable label. In an even more preferred embodiment, the primer or probe that hybridizes and stringent conditions to a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10 additionally comprises a quencher moiety.

The invention also relates to the use of a primer or probe that hybridizes under stringent conditions to a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10 for the diagnosis of prostate cancer.

In a preferred embodiment, the invention relates to a primer or probe that hybridizes under stringent conditions to a splice variant of Ensembl gene ID ENSG00000245750.3 selected from the group consisting of SEQ ID NO: 4, SEQ ID NO: 5, SEQ ID NO: 6, SEQ ID NO: 7, SEQ ID NO: 8, SEQ ID NO: 9 and SEQ ID NO: 10, or any part thereof, wherein said primer or a probe is preferably a labelled probe.

The invention further relates to a nucleic acid with a sequence from the group of SEQ ID NO: 1 to 42, or the reverse complement thereof, or a nucleic acid that shares preferably at least 85%, 90%, 95% or 99% sequence identity with a nucleic acid according to any one of the nucleic acids according to SEQ ID NO: 1 to 42.

In a preferred embodiment, the invention relates to a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10 or the reverse complement thereof, or a nucleic acid that shares preferably at least 85%, 90%, 95% or 99% sequence identity with the selected nucleic acid.

In a more preferred embodiment, the invention relates to a splice variant of Ensembl gene ID ENSG00000245750.3 selected from the group consisting of SEQ ID NO: 4, SEQ ID NO: 5, SEQ ID NO: 6, SEQ ID NO: 7, SEQ ID NO: 8, SEQ ID NO: 9 and SEQ ID NO: 10 or the reverse complement thereof, or a nucleic acid that shares preferably at least 85%, 90%, 95% or 99% sequence identity with the selected nucleic acid.

The invention further relates to the use of a nucleic acid with a sequence from the group of SEQ ID NO: 1 to 42 for the diagnosis of prostate cancer.

In a preferred embodiment, the invention relates to the use of a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, or its revers complement for the diagnosis of cancer.

In a more preferred embodiment, the invention relates to the use of a splice variant of Ensembl gene ID ENSG00000245750.3 selected from the group consisting of SEQ ID NO: 4, SEQ ID NO: 5, SEQ ID NO: 6, SEQ ID NO: 7, SEQ ID NO: 8, SEQ ID NO: 9 and SEQ ID NO: 10, or its revers complement for the diagnosis of cancer.

The invention also relates to a kit for the screening and/or diagnosis of prostate cancer comprising a primer or probe that hybridizes under stringent conditions to a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10. The kit may contain more than one nucleic acid. In a preferred embodiment, the kit additionally comprises reagents for nucleic acid amplification and/or quantification and/or detection. In another embodiment, the kit comprises control samples.

In a preferred embodiment, the invention relates to a kit for the screening and/or diagnosis of prostate cancer comprising a probe or primer that hybridizes under stringent conditions to a splice variant of Ensembl gene ID ENSG00000245750.3 selected from the group consisting of SEQ ID NO: 4, SEQ ID NO: 5, SEQ ID NO: 6, SEQ ID NO: 7, SEQ ID NO: 8, SEQ ID NO: 9 and SEQ ID NO: 10. The kit may contain more than one nucleic acid. In a preferred embodiment, the kit additionally comprises reagents for nucleic acid amplification and/or quantification and/or detection. In another embodiment, the kit comprises control samples.

In an alternative embodiment, the invention relates to a method for the treatment and diagnosis of prostate cancer comprising the steps of analysing in a sample from a patient the expression level of a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, SEQ ID NO: 9 and SEQ ID NO: 10, wherein, if the expression level of said nucleic acid is above a threshold value, the sample is designated as prostate cancer positive; and administering to the patient one or more Prostate Cancer Therapeutic Agents.

In a preferred embodiment, the invention relates to a method for the treatment and diagnosis of prostate cancer comprising the steps of analysing in a sample from a patient the expression level of a splice variant of Ensembl gene ID ENSG00000245750.3 selected from the group consisting of SEQ ID NO: 4, SEQ ID NO: 5, SEQ ID NO: 6, SEQ ID NO: 7, SEQ ID NO: 8, SEQ ID NO: 9 and SEQ ID NO: 10, wherein, if the expression level of said nucleic acid is above a threshold value, the sample is designated as prostate cancer positive; and administering to the patient one or more Prostate Cancer Therapeutic Agents.

In one embodiment, the Prostate Cancer Therapeutic Agents comprises: Docetaxel (Taxotere®); Cabazitaxel (Jevtana®); Mitoxantrone (Novantrone®); Estramustine (Emcyt®); Doxorubicin (Adriamycin®); Etoposide (VP-16); Vinblastine (Velban®); Paclitaxel (Taxol®); Carboplatin (Paraplatin®); Abiraterone acetate, Bicalutamide, Casodex, Degarelix, Enzalutamide, Goserelin acetate, Leuprolide acetate, Prednisone, Sipuleucel-T, Radium 223 dichloride and/or Vinorelbine (Navelbine®).

As will become clear from the examples below, the invention discloses biomarkers for prostate cancer, which allow a more accurate and sensitive diagnosis of the disease than current biomarkers.

EXAMPLES

Materials and Methods

Clinical Cohort

Prostate carcinoma (PCa) patients who underwent radical prostatectomy (RPE) or surgery to remove a benign prostate hyperplasia (BPH) at the University Hospital of Dresden were included in a retrospective clinical cohort aiming at identifying novel biomarkers for PCa. Approval from the local ethics committee as well as informed consent from the patients were obtained according to the legal regulations. Data on the clinical follow-up were collected for at least five years for the PCa patients.

Prostate tissue samples from a cohort of 40 PCa patients and 8 BPH patients were used for identification of diagnostically relevant biomarkers by genome-wide RNA sequencing. Four PCa groups were defined based on staging according to Gleason (The Veteran's Administration Cooperative Urologic Research Group: histologic grading and clinical staging of prostatic carcinoma; in Tannenbaum, M. Urologic Pathology: The Prostate, Philadelphia: Lea and Febiger. Pp. 171-198) as well as the presence of metastases in the adjacent lymph nodes upon RPE (see Table 3).

TABLE 3

PCa cohort for genome-wide RNA sequencing screening: The control group (C) consists of BPH samples. The very low risk (V) and low risk (L) groups comprise samples from patients graded with Gleason Score (GS) <7 and =7, respectively, all without lymph node metastases (pN0). The medium risk (M) group comprises cases with GS <=7 and exhibiting lymph node metastases (pN+); and the high risk (H) group consist of tissues with GS >7. For the latter, pairs of tumour and tumour-free tissue samples obtained from the same patient were analysed.

| | Group | | | | | | | |
|---|---|---|---|---|---|---|---|---|
| | C | V | L | M | H | | | |
| Gleason score | BPH | GS <7 | GS =7 | GS <=7 | GS >7 | | | |
| lymph node metastasis | — | pN0 | pN0 | pN+ | pN0 | | pN+ | |
| tissue | control | tumour | tumour | tumour | tumour | tumour-free | tumour | tumour-free |
| number of samples | 8 | 8 | 8 | 8 | 8 | 8 | 8 | 8 |

Selected biomarker candidates were further validated by custom microarrays and quantitative reverse-transcription real-time PCR (qRT-PCR) on cohorts comprising 256 (40 control BPH, 216 tumour samples) and 56 patients (16 control BPH samples, 40 tumour samples), respectively.

Prostate Tissue Samples

Prostate tissue samples were obtained from surgery carried out at the Dept. of Urology of the University Hospital of Dresden and stored in liquid nitrogen at the Comprehensive Cancer Centre of Dresden University. Prostate tissue samples obtained from radical prostatectomies (RPEs) of prostate carcinoma (PCa) patients were divided into tumour and tumour-free samples. Prostate tissue samples from patients with benign prostate hyperplasia (BPH) were used as controls. Patient consent was always given.

To verify the status of the samples and their tumour cell content, all samples were divided into series of cryosections. To this end, frozen tissue samples were embedded in Tissue-Tek OCT-compound (Sakura Finetek GmbH) and fixed on metal indenters by freezing. Cryosections were prepared using a cryomicrotome (Leica) equipped with a microtome blade C35 (FEATHER) cooled to −28° C. Every sample was cut into a total of 208 cryosections, 4 of which were HE-stained and evaluated by a pathologist with respect to their tumour cell content (FIG. 1). This yielded 3 stacks of consecutive cryosections, each of which was flanked by HE-stained sections. Only stacks that were flanked on either side by sections containing at least 60% or at most 5% tumour cells were used as tumour or tumour-free samples, respectively. 50 cryosections of the stacks chosen were then subjected to RNA preparation.

RNA Isolation

Total RNA was isolated from cryo-preserved tissue using Qiazol and the miRNeasy Mini Kit on the QIAcube (all from Qiagen) with manual subsequent DNase I digestion. RNA concentration was determined using a Nanodrop 1000 (Peqlab). RNA integrity was verified on an Agilent Bioanalyzer 2100 (Agilent Technologies, Palo Alto, Calif.), and only RNA samples with an RNA-Integrity-Number (RIN) of at least 6 were further processed.

Genome-Wide Long-RNA Next Generation Sequencing

Genome-wide long RNA sequencing was performed using a subset of the retrospective PCa cohort comprising 8 prostate tissue samples from benign prostate hyperplasia (BPH) as a control and 56 samples from patients with prostate cancer (including tumour and tumour-free tissue pairs from samples with Gleason score >7). 1 μg of total RNA was depleted of ribosomal RNA using the Ribo-Zero rRNA Removal Kit (Epicentre). Sequencing libraries were prepared from 50 ng of rRNA-depleted RNA using Script-Seq v2 RNA-Seq Library Preparation Kit (Epicentre). The di-tagged cDNA was purified using the Agencourt AMPure XP System Kit (Beckman Coulter). PCR was carried out through 10 cycles to incorporate index barcodes for sample multiplexing and amplify the cDNA libraries. The quality and concentration of the amplified libraries were determined using a DNA High Sensitivity Kit on an Agilent Bioanalyzer (Agilent Technologies). 4 ng each of 8 samples were pooled and size-selected on 2% agarose gels using agarose gel electrophoresis. The sample range between 150 bp and 600 bp was gel-excised and purified with the MinElute Gel Extraction Kit (Qiagen), according to manufacturer's instructions. The purified libraries were quantified on an Agilent Bioanalyzer using a DNA High Sensitivity Chip (Agilent Technologies). Every purified and size-selected library pool was then loaded onto an Illumina HiSeq2000 flow cell, distributing it among all lanes. Cluster generation was performed using TruSeq PE Cluster Kits v3 (Illumina Inc.) in an Illumina cBOT instrument following the manufacturer's protocol. Sequencing was performed on an Illumina HiSeq2000 sequencing machine (Illumina, Inc.). The details of the sequencing runs were as follows: paired-end sequencing strategy; 101 cycles for Read1, 7 cycles for index sequences, and 101 cycles for Read2.

Analysis of Sequencing Data: Raw Data Preparation

Raw sequencing data comprising base call files (BCL files) was processed with CASAVA v1.8.1 (Illumina) resulting in FASTQ files. FASTQ files contain for each clinical sample all sequenced RNA fragments, in the following referred to as "reads". Specific adapter sequences were removed by using cutadapt (code.google.com/p/cutadapt/).

Analysis of Sequencing Data: Genome Mapping and Transcript Assembling:

Reads were mapped to the human genome (assembly hg19) using segemehl v0.1.4-382 and TopHat v2.0.9. Novel transcripts, i.e. transcripts not annotated in Gencode v17, were assembled using Cufflinks v2.1.1 and Cuffmerge v2.1.1. All novel transcripts and all known Gencode v17 transcripts were combined into a comprehensive annotation set.

Analysis of Sequencing Data: Statistical Analysis

Htseq-count v0.5 .4p 1 (www-huber.embl.de/users/anders/HTSeq/doc/count.html) was used to compute the read counts per transcript and gene that are contained in the comprehensive annotation set of novel and known transcripts. Differentially expressed transcripts and genes were identified using R and the Bioconductor libraries edgeR. Different RNA composition of the clinical samples was adjusted for by scaling library size for each sample (TMM method). A negative binomial log-linear model was fitted to the read counts for each transcript or gene, and coefficients distinct from zero identified by a likelihood ratio test. False discovery rate was controlled by Benjanimi-Hochberg adjustment.

Validation by Custom Microarrays

Based on the sequencing results custom microarrays with 180 000 probes (Agilent SurePrint G3 Custom Exon Array, 4×180K, Design-ID 058029) were designed comprising mRNAs, long non coding RNAs (gencode v15), new transcripts and all transcripts found by RNA sequencing to be expressed differentially between tumour and control tissue samples. Probe design was done using the Agilent custom design tool eArray.

The microarray screening was performed using the retrospective PCa cohort comprising 40 prostate tissue samples from patients with benign prostate hyperplasia (BPH) as a control as well as 164 and 52 tumour and tumour-free tissue samples, respectively, of prostate cancer patients after radical prostatectomy. Using the Quick Amp Labeling Kit (Agilent) cRNA was synthesized from 200 ng total RNA, and 1650 ng cRNA were hybridized on the arrays (Agilent Gene Expression Hybridization Kit).

Analysis of RNA Custom Microarray Data:

Differentially expressed probes were identified by using R and the Bioconductor library "limma". Quality control of arrays was performed by checking distribution of "bright corner", "dark corner" probes, and relative spike-in concentration versus normalized signal. To retrieve a set of probes mapping to unique genomic positions in hg19 BLAT with the parameter–minIdentity=93 was used. All probes mapping to more than one distinct genomic region were discarded. Normalization between arrays was done by using quantile normalization. In order to reduce the number of tests non-specific filtering was applied as follows: The expression of a probe must be larger than background expression in 10% of arrays. Background expression is defined by the mean intensity plus three times the standard deviation of negative control spots (Agilent's 3×SLv spots). In addition, a probe must exhibit a nonspecific change of expression of at least IQR greater than 0.5. Finally, a linear model was fitted using the R package limma and reliable variance estimates were obtained by Empirical Bayes moderated t-statistics. False discovery rate was controlled by Benjamini-Hochberg adjustment.

Validation by Quantitative Real-Time PCR

For validation of the results obtained by next generation sequencing and microarray screening 56 tissue samples (16 tumour-free and 40 tumour samples) were analysed using quantitative real-time PCR. cDNA was synthesized from 100 ng total RNA using the High-Capacity Reverse transcription kit (Applied Biosystems) and random primers according to manufacturer's instructions. Subsequent PCR assays were run using 4 μl of the diluted cDNA. Quantitative real-time PCR was performed using custom- and pre-designed TaqMan Gene Expression Assays (Applied Biosystems) for housekeeping and target transcripts on an Applied Biosystems 7900HT Real-Time PCR System.

TABLE 4

IDs of the Applied Biosystems TaqMan Gene Expression Assays used for qRT-PCR validation in prostate tissue samples.

| | Housekeeping/Target name | TaqMan Assay ID |
|---|---|---|
| Housekeeping | GAPDH | Hs02758991_g1 |
| | HPRT1 | Hs02800695_m1 |
| | HMBS | Hs00609293_g1 |

TABLE 4-continued

IDs of the Applied Biosystems TaqMan Gene Expression Assays used for qRT-PCR validation in prostate tissue samples.

| | Housekeeping/Target name | TaqMan Assay ID |
|---|---|---|
| Target | SEQ ID NO 1 | AJ70L28 |
| | SEQ ID NO 9 | Hs01388451_m1 |
| | SEQ ID NO 3 | AJCSVRJ |
| | PCA3 | Hs01371939_g1 |

All samples were measured in triplicate and the means of these measurements were used for further calculations.

Statistical Analysis of the qRT-PCR Results

Data normalization was carried out against the unregulated housekeeping genes GAPDH and HPRT1. For relative quantification, changes in gene expression of each sample were analysed relative to the median expression of the control samples. All statistical analyses were carried out using R statistical software.

The log2-transformed relative expression levels of the biomarkers were compared between tumour and control samples employing Student's t-test. Receiver-operating characteristic (ROC) curves, representing a measure of diagnostic power of each marker by the area under the curve (AUC), were calculated using the package pROC.

Validation in DRE Urine Samples: DRE Urine Sample Collection and RNA Isolation

Urine samples were collected after digital rectal examination (DRE) of the prostate (DRE urine). This routinely performed examination method allows getting urine samples that contain a certain amount of prostate cells. The DRE urine samples were centrifuged and washed two times using PBS. The resulting cell pellet was resuspended in 700 μl Qiazol. Total RNA was isolated using the miRNeasy Mini Kit on the QIAcube (all from Qiagen) with manual subsequent DNase I digestion. RNA concentration was determined using a Nanodrop 1000 (Peqlab). RNA integrity was verified on an Agilent Bioanalyzer 2100 (Agilent Technologies, Palo Alto, Calif.).

Quantitative Real-Time PCR Screening of DRE Urine Samples cDNA was synthesized from 2×50 ng total RNA using the Superscript III Reverse transcriptase (Applied Biosystems) and random primers according to manufacturer's instructions. Subsequent PCR assays were run using 4 μl of cDNA. Quantitative real-time PCR was performed using custom and pre-designed TaqMan Gene Expression Assays (Applied Biosystems) for housekeeping (PSA) and target transcripts on an Applied Biosystems 7900HT Real-Time PCR System. All samples were measured in duplicate and the means of these measurements were used for further calculations.

Genome-Wide Long-RNA Next Generation Sequencing of DRE Urine Samples

For genome-wide long RNA sequencing total RNA from 7 DRE urine samples was precipitated using ethanol to concentrate the RNA amount and resuspended in 10 μl RNase free water. The rRNA removal was performed with 4 ng of total RNA using the Low input Ribo-Zero rRNA Removal Kit (Epicentre, modified by Clontech), resulting in 10 μl rRNA depleted RNA. Sequencing libraries were prepared from 8 μl rRNA-depleted RNA using the SMARTER stranded RNAseq Kit (Clontech). The di-tagged cDNA was purified using the Agencourt AMPure XP System Kit (Beckman Coulter). PCR was carried out through 18 cycles to incorporate index barcodes for sample multiplexing and amplify the cDNA libraries. The quality and concentration of the amplified libraries were determined using a DNA High Sensitivity Kit on an Agilent Bioanalyzer (Agilent Technologies). Samples were pooled and cluster generation was performed using 15 pmol/l of the pooled library and the TruSeq PE Cluster Kit v4 (Illumina Inc.) in an Illumina cBOT instrument following the manufacturer's protocol. Sequencing was performed using the HiSeq SBS v4 sequencing reagents (250 cycles) on an Illumina HiSeq2500 sequencing machine (Illumina, Inc.). The details of the sequencing run were as follows: paired-end sequencing strategy; 126 cycles for Read1, 7 cycles for index sequences, and 126 cycles for Read2.

RNA were used to ensure high library complexity. Furthermore, on average 200 M paired-end reads 2×100 nt per library were sequenced, enabling the assembly of novel lowly expressed transcripts due to high coverage. This approach outperformed most comparable published studies that analysed larger numbers of samples. In total, approx. 3000 novel transcripts that did not show an exonic overlap with transcripts annotated in Gencode v17 were assembled. At a false discovery rate of 0.01, 6442 differentially expressed genes across all contrasts were observed. Numbers of differentially expressed genes for specific contrasts are given in Table 6.

TABLE 6

Number of differentially expressed genes for diverse contrasts and Gencode biotypes.

| Contrast | Total | Protein coding | lincRNA | Antisense | Sense-intronic | Pseudogene | Novel transcript | Non-protein coding |
|---|---|---|---|---|---|---|---|---|
| Tumour vs. Control | 5615 | 3882 | 116 | 96 | 13 | 456 | 847 | 1733 |
| Tumour Gleason >7 vs. control | 2677 | 1812 | 73 | 40 | 4 | 88 | 552 | 865 |
| Tumour high and medium vs. Tumour low and very low | 138 | 51 | 3 | 2 | 0 | 7 | 72 | 87 |
| Tumour Gleason =7 vs. Tumour Gleason <7 | 12 | 6 | 0 | 1 | 0 | 0 | 5 | 6 |
| Tumour Gleason >7 vs. Tumour Gleason =7 | 14 | 7 | 0 | 0 | 0 | 1 | 6 | 7 |

Statistical Analysis of the qRT-PCR Results From DRE Urines

For analysis of qRT-PCR results from DRE urine samples data normalization was carried out against the prostate specific antigen (PSA). For relative quantification, changes in gene expression of each sample were analysed relative to the median expression of the control samples. All statistical analyses were carried out using R statistical software.

TABLE 5

IDs of the Applied Biosystems TaqMan Gene Expression Assays used for qRT-PCR validation in DRE urine samples.

| | Name | TaqMan Assay ID |
|---|---|---|
| Housekeeping | GAPDH | Hs02758991_g1 |
| | HPRT1 | Hs02800695_m1 |
| Target | SEQ ID NO: 1 | AJ70L28 |
| | PSA | Hs02576345_m1 |

Results

The transcriptomes of 40 PCa tumour samples and 16 tumour-free samples obtained upon RPE and 8 BPH prostate tissue samples as benign, non-tumour controls were analysed using strand-specific, paired-end long RNA next generation sequencing (NGS).

Approximately 150 cryosections per sample in at least three segments were prepared, aiming at an optimal data quality and robustness of the analysis. Upon pathological evaluation, only segments satisfying a maximal and minimal tumour cell count of 60% and 5% in tumour and tumour free samples, respectively, were retained for further analysis. The transcriptome sequencing (RNAseq) approach aimed at a comprehensive identification and quantification of RNAs expressed in normal or cancer prostate tissue. All classes of coding and long non-coding transcripts independent of polyadenylation status were sequenced. Large input masses of The results successfully reproduced the majority of transcripts previously reported to be differentially expressed between prostate tumour and normal tissue. In addition, a number of novel PCa-associated transcripts were identified, which can be used to develop assays for the diagnosis of PCa. The most promising transcripts were selected for validation in a test cohort of PCA tumour and BPH control samples by qRT-PCR.

Several of these novel biomarker candidates significantly surpass the specificity and sensitivity of the biomarker PCA3, which is already used for PCa diagnosis. In the sequencing cohort, PCA3 proved to be clearly associated with PCa, yet with a strong tendency to a decline in the high-risk group (FIG. 2).

The experimental results demonstrate high specificity and sensitivity of the novel biomarkers for the detection of PCa. Therefore, assays can be set up based on the measurement of these newly discovered biomarkers alone or in combination (or in combination with other markers) in all sources that may contain prostate tumour cells or parts thereof (including vesicles like exosomes, microvesicles, and others as well as free or protein-bound RNA molecules deriving from prostate tumour cells) to be used for the diagnosis of PCa. These sources include (but are not limited to) prostate tissue, biopsy material, lymph nodes, urine, ejaculate, blood, blood serum, blood plasma, circulating tumour cells in blood or lymph, as well as any tissue suspected to contain PCa metastases. Measurement of our RNA biomarkers can be done by any method suited to specifically estimate RNA levels, e.g. PCR-based methods like qRT-PCR. The assays can be applied for early diagnosis (screening) of PCa, for predicting the aggressiveness of the tumours (prognosis), and/or for aiding the choice of therapy.

Figure 6:
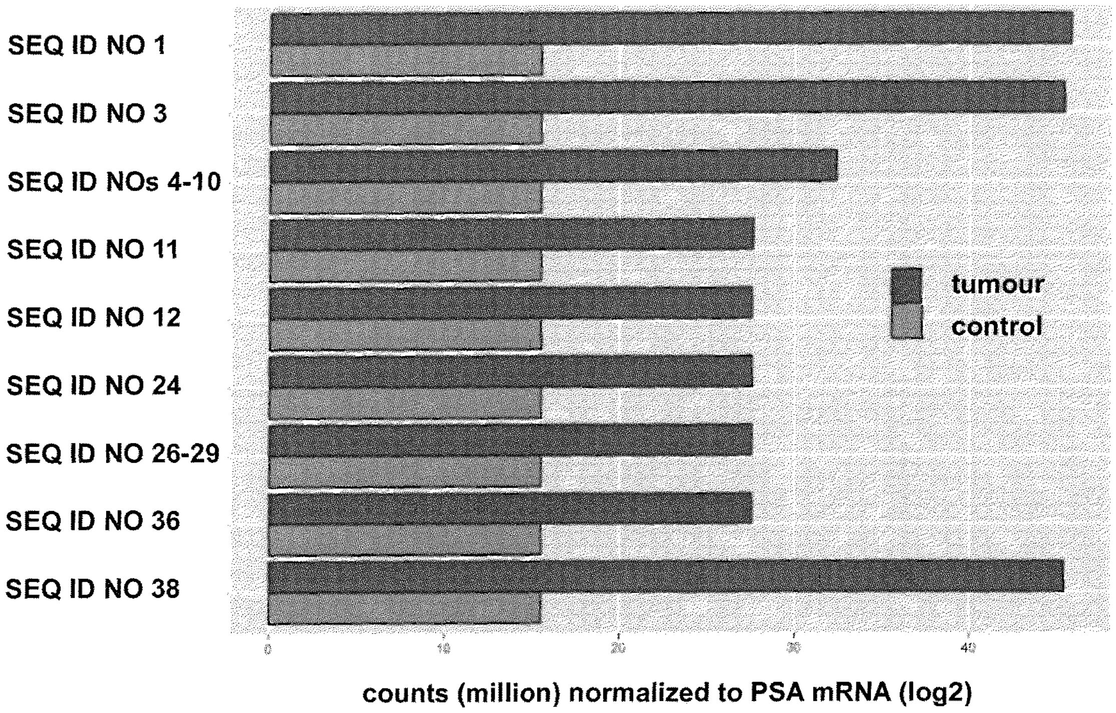
FIG. 6: Urine samples of patients with prostate cancer (Tumour) and healthy patients (Control) were obtained after digital rectal examination by a urologist. RNA isolated from these samples was subjected to transcriptome-wide RNA sequencing using an Illumina HiSeq2500 next-generation sequencer. Reads were mapped to the genome by standard algorithms. Reads mapping to the genomic loci of the transcript SEQ ID NOs shown were counted and normalized to reads derived from the gene locus of prostate-specific antigen as a measure for the presence of prostate epithelium cells in the urine for normalisation. Read numbers (million) are shown as log 2 values.

The results from the detection of a selection of biomarkers in urine can be seen in FIG. 6. The expression levels of all of the biomarkers shown in this figure are higher in the urine of patients suffering from prostate cancer compared to healthy individuals. This shows that analysing the expression level of one of these biomarkers in urine allows diagnosing prostate cancer. This is surprising because Fontenete et al., (Int. braz j urol. vol. 37 no. 6 Rio de Janeiro November/December 2011) showed that the mRNA of PSA is not a suitable biomarker for prostate cancer in urine samples, as it was found to be overexpressed more frequently in healthy patients than in PCa patients in these samples. Therefore, it was not a priori evident that analysing the biomarker expression levels in urine samples could be used to reliably diagnose prostate cancer.

The advantages of a diagnostic assay based on these biomarkers allows a dramatically lower false-positive rate compared to current assays and measuring their expression levels in urine sample avoid having to perform unnecessary invasive prostate biopsies.

SEQUENCE LISTING (42 sequences)

SEQ ID NO: 1 - DNA, 825 bp, Homo sapiens
ttttccggctggaaccatggagggtgttgaagagaagaagaaggttcctgctgtgccagaaacccttaagaaaaagtgaaggaatttcacagagctgaagatcaagcgcctgagaaataagtttgcccaaaagatgcttctaaaggcaaggaggaagcttatctatgaaaaagcaaagcactatcacaaggaatatatgcagatgtacagaactgaaattcaaatatcgaggatggcaagaaaagctggcaacttctatgtatctgcagaacccaaattggcgtttgtcatcaggatcggaggttatcaattgggtgagcccaaaggtctgaaaggtgttgcaacttctttgccttcatcaaatcttcaatagaaactttgtgaagctcagcagggcttcaataatgtgctgaggtttgtagaaccatatattgcatgggcatacccaaatctgaagtcagtaaataaactaatctacaaatgtggttatagcaaaatgaataagaagctacttgctccaacagataatactttgattgctcgatctcttggtaaatatggcctcatctgcatggaggatctgattcatgagatctatactgttggaaaatgcttaaagaagcaaataacttcctgtggcccttcaaattatcctctcgacaagttagaatgaagaaaaagaccaccaattttgtagaaggtggagatgctgacaacagggaagaccagatcaacaggcttattagaagaataaacatgcctaccacaattattttttgtaatctagccagttaataaacagtacctgctctcaaattgaaaaaa

SEQ ID NO: 2 - DNA, 3120 bp, Homo sapiens
gcccgcttctgtgactccaccccttacggaaagtctatgggactctctgaaatgtatgagtgatactgttagaaagcggcaagaaaatgaaaagaaaacgtggatgttttccatatttgagttgatgcaggctggagacaacagctgccagagctgcaaggcagaacaccctgagaagtggaaccggaggatccaggcgcctgttgaagggataaatgagagccgtggcgtgtggatgggactctttctgtcttccgtttggctgaagctccaaacgccaggagtaacccagtgggtagcaagcacccttccctccacctctgcaggaattgcaaaaagcaatggtaaaaaaattggtttgtgatccttaccccagtgctcaaggaggttggagaagctgaaagagaggactggttttgatatggtttggatttgtgtccccacccaaatctcatgtcaaatggtaatccccagtgttggaggagggactggtgggaggtgattggatcatgggggcgaatttccccttgctgttctcgtgatagtgagtgagttctcatcagatctgattgcttagaagtgtgtagtgctggccgggtgcggtggctcacgcctgtaatcccagcactttgggaggccaaggcgggcagatcatgagatcaggagatagagaccatcctggccaacatggtgaaaccccgtctctactaaaaatataaaaattagctgggcgtggtggcgtgtgcctgtagtctcagctgcttgggaggctgaggcaggagaatagcttgaacctgggaggcggaggttgcagtgagccgagatcgtgccactgcactccagcctggcgacagagcaagactccatctcaaaaaaaaaaaaaaaaaaaaaaaaaagaagtgtgtagtgcctcccacctctctctcttcctcctgccccagccatgtgaacacattccttctttccctttgccttgctccgtgagtgtaagtttcctgaggcctcctcagccatgcttcctgtatagcctgcagaactgtgggccagttaaacctcttttctttgtaaattacccagtctcaggtattttttttagcagtgcgagaacgaagggactaatacaggtttggagacacgtctttggagaaactattgatacttggcgtcctgtggcatttccttgccattagcacctccaacgttatgctggagaaaaagccgttccaactcttcaccgaacgccgagtcagagagatgtggggaaaccaccgaaagagcttgccctgtgtcttctggacagactagtgccaaacccatgcctggaaatgggtagaagttagggaccatggccgctcagcctctgcaggaaaatggattactgcatcaggaatgatgactttagagaaggccaaaggtgtaagtttcttccagcaggttctgaacctccagaggcagctggcctggggttatttgggattcccagtgcaggactgcctgaaaatgtgaggcgcccaaatggggctgctggaccacaggatgcccaggacctgcaggcacactcaagagtggcctgccagaggagacacattgcctgcctcccaggaagcaaatttggaggttgccagtgggagaattgccaagaaccgccatccctcccctgggacacacaagctaaggaaagaaggaattggccctctaagtccagaaagcacaagatcacatcatcacaacaccagccaagtaaaacatccctgctcctcacctcttcagagcccaagggggctggggaggagaagaaatgagagtggaggaggaaagaggtttaatatgaatgaagtttggagttttgacatgactcgacattctaatgacttcatttagactgttgctacactcagaagtgacttggagacattttatttttataatcatcaccatattgttattggtcatgatctaagggtgaggagaagggctaaaggatcggcccaatggatcattcggggaaagtaaagaactatcccaccagttgtgtttgaatgggcagtgagagggaaaatcaagttgctacttgcacccctctaactcccaacttccactctttcaacataccagacatgaaagctgagtaaatgacctcaaaggtacagcgatgacagggtgtggtggtggtagttcttggtttcctacattgcatcttcaaatcgggttttagaatggatgacactggaaggctagaaatctcaggtactgacatgtgggctggtttataattgtcttcaaaaattcacccacaataggatcagacaagttagtatggccataggtgctacaatgggagaaagttttaaatgctgttcagatcggaagacatgggtcaaaaagatcaagaagagttgacatgaggcaaacattttatatctccattcaagagctacctgatgaggtttcacccatcagggatacaatgagaatttactgggcgcctagcactgtgcagacacaattcaagcaaaaggcaaccaactctggcatccaagtgcaggccagcagccaagttcttcctccttatgagctgacatctgattgacagatggccccagagaaagcttcttggatcatatctcagtaaccactggcccagcctgtcaaatccagagatttaagatggcatagcaccttaaatctggaagaacttagcaactttataatgtcaaatccagggggaaaatacgcacacagagaaaccagaaaagcatagaatggtggggagaaagaaagaaagaaaatgaaaacactgtttccatcggcagaattagcctttgccaggaaaactgcaatgttgtcttggtaggcacataattcatttttctacatgttcagaagtaaagaaaaagccagacccaaaaagccagaccctgggggaaatcgtggatactgtttgtaactttggcaaagacaatatatttgtgaactcagcctcatgtgaaatgcttgataatctcaaaaagtaaatgccacagcgtgtcgtatactgtgtggtctcaatgatgtgagaatgtctatatatcccaatacctgtcctcgtttctaactagcttgatttattgtcatagacaa

SEQ ID NO: 3 - DNA, 1641 bp, Homo sapiens
attgcccacagccggatccacggtgactaatctccgggaaggcgtccagcgtgagccgtgaggcctgcacctgcgccggacttcaccactcaccaggagtctctgcccgccgcccccagcgcggttctcttccctgctagacgtaaagtcctggggacaagcacagcccagggcactttctggagagaagatttcgatggggaaagataagagagcatttggatatctacgcactgtcaacagaaatgaggcttcaggccaaggcttctaaaatgcaggattcccaaagtggcagtcacataagacgggtccctccatcgccttctagaatattgagaagatcatcacgcctgggactggctcacagcactgatctttttcttgttagcagagactccaggaagcagatgagcagacctatgggcctgctatgtgcaccgcggcccacactgccgcctgcctgggatcctgcatcacccgagtcttcctgcggaccaccctgggtggtgcacatgcggtcatcattgtgcaaaggaagctttagttctataatgaaagcccctttagtaagtgatgctccttgaagactcggtcagcgtctcgttcacctctttatccccagacttagcacaattccagccccaaatcggcaacggacctttgaccaagtgacatgtcagtgcttcagggagcttcactgatcaggacagaagtgagtgactggaggaaggtgacccggatgtctgtaacccccagaaagggtgagatggctgttttatcagccagcattgccgagttggtggtgtgacgacatcctgtctgactgctgggccttaccggtgtgttctctgctggagccgtgacagtttgagttgaggacattttacatcaatcactgaactgcacgaaagatggaaatccagcaagggaccccgtcggacctgattgaccgcagagctaccttttgctctttctggatgccacacggcctcctcctcccacctgtccttggagcttgtgttggtccactttcatgctgctgataaagccatacctgagactgggtaatttataaagaaaaagaggttgaatggactcacagttccacgtggctggggaggcctcacaatcacggcggaagttgaaaggcacgtcttacatggcggcaggcaagagagaatgagagccaagcaaagggggtttccccttatagaaccatcagatcagctgggcgcagtggctcactcctgtaatcccagcactttgggatgctgaggtgggaggatcacaaggtcaggagtttgagaccagcctgaccaatatggtgaaaccccatctctactaaaaatacaaaaattatctgggcatggtggtgggcacctgtagtcccagctactcgggaggctgaggcaggagaatcgcttgaacctgggaggcggaggttgcagtgagctgagattgtgccactgcactctagcctgggcaacaaagcgagacgctgtctcaaaaaaacaaaaacaaaaacaaaaaaaaccatcagatctcatgagacttattcactaccatgagaacagtatgggggaaaccaccctcatgattcaattatctcttgctgggtccctccctcaacacatgggaatt

SEQ ID NO: 4 - DNA, 826 bp, Homo sapiens
caggaatgggctggggcgcgtttgtagttgggaatcctgagcccgggctgttgcttggaggactcgggagcagcagtggatttcggcgttaccaggagagctatgtataggaatgccgctatggaaagacatccaggacaccttgttaagtgaaaaaaggttcagtatctgaacacttttgctaaaggtctctggaaagctccctgtgttaattctcgatgagactacgtctgtgccggccgcttcctgagcctccttccatgtgcataggcctgctgcatgctggagacctgcggcacagctgccaagtgccccgtgtggttctgtgatcttgggacagtcacttcctctctgtggttgtcagtcttctcatccctaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatctttctccaggaaaaatctgtccttggcccaatgtgtaaacacttgctgaggaacttggaataacttgcagtgtcttgcagtattgtgaaaccag

SEQ ID NO: 5 - DNA, 806 bp, Homo sapiens
ttcggcgttaccaggagagctatgtataggaatgccgctatggaaagacatccaggacaccttgttaagtgaaaaaagacatgccaccattagggcttcatttccctgcagtcttctttaaataccaaaactgccctgggaaggataagacatcagtttcttcatacttcagagcaaatgggattgattcccaggacctcctttctgtggactgggtttttgcctcctcaccaagagactgggctccctgggcgagcagaggctgctgggttcagtatctgaacacttttgctaaaggtctctggaaagctccctgtgttaattctcgatgagactacgtctgtgccggccgcttcctgagcctccttccatgtgcataggcctgctgcatgctggagacctgcggcacagctgccaagtgccccgtgtggttctgtgatcttgggacagtcacttcctctctgtggttgtcagtcttctcatccctaagcactcaagaagcccttccttctctggctgtcaagtctggactcatctcttgtcttacacacggacagttgttttaaggaaaagcccctggttggacttgcagattgggcacagccctggacgtatactacaggtgctcatcaaggcttgcctcatctgtttaccctccaggtcatgcccctttctacctctacaccctgttgcattgcgggcatggcctccggaaaagtcaagcatggcgaaaggaagcgtggcccagagctggcacgccacaggaacttggaataacttgcagtgtcttgcagtattgtgaaacc

SEQ ID NO: 6 - DNA, 1358 bp, Homo sapiens
gaggcccgacattgtgctggggaaggagctccagaaagggccatcctttctgttttggttcagtatctgaacacttttgctaaaggtctctggaaagctccctgtgttaattctcgatgagactacgtctgtgccggccgcttcctgagcctccttccatgtgcataggcctgctgcatgctggagacctgcggcacagctgccaagtgccccgtgtggttctgtgatcttgggacagtcacttcctctctgtggttgtcagtcttctcatccctaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatctttctccaggaaaaatctgtccttggcccaatgtgtaaacacttgctgaggaacttggaataacttgcagtgtcttgcagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcgtgaacttcaaagggcagaggggaaactgtcccttggcctctacccctccaaggccccacttttttgtcaacactccttggacgcagcagaagtatgaacataatatggtcctgaatgaggctgagtctttgggcgcagaagacccgggttaataaaaataggaaggtaagaaaagaaaagaaaaatcaagacacatcataggactaaattcctattatttatccactcaggattgaccacccctttgggccagatagttgtacccccatgtaccaggtgggcacatgaagacacaagaagtgctgtgatggttcattttgcacgtcaccttgcgtggagtatgc

SEQ ID NO: 7 - DNA, 309 bp, Homo sapiens
gactggagaggccagcacgcacagtgacttaatccaagaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcaga

SEQ ID NO: 8 - DNA, 1222 bp, Homo sapiens
ctgggcttccagcttccaagccttctacctgtggaatgcttggtccaatgtctggggcacccactcttactccaaactcctccagatctgcagagtggcccagcatattctcttcttgaaaggaggtctttgcctaacagaaatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatctttctccaggaaaaatctgtccttggcccaatgtgtaaacacttgctgaggaacttggaataacttgcagtgtcttgcagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcgtgaacttcaaagggcagaggggaaactgtcccttggcctctacccctccaaggccccacttttttgtcaacactccttggacgcagcagaagtatgaacataatatggtcctgaatgaggctgagtctttgggcgcagaagacccgggttaataaaaataggaaggtaagaaaagaaaagaaaaatcaagacacatcataggactaaattcctattatttatccactcaggattgaccacccctttgggccagatagttgtacccccatgtaccaggtgggcacatgaagacacaagaagtgctgtgatggttcattttgcacgtcaccttgcgtggagtatgc

SEQ ID NO: 9 - DNA, 1345 bp, Homo sapiens
ggagctggttccaggaaagaagggcacatgagcaaacatgatggcccctttatgagaggtaatttactgaaatgcacagcgattacctgctcacccagccctgatgtaattaaaaatggcaggctaggggctctgtttcccccggctctggcagagaaacctgggtttcgacttgtgaagcttgaggttggatgtgggaattggcttggagtcataggcgatgagagggacattaggatattatgaagcccgtgaactcaactcctgagaaggacgcagcagagcgagagaaaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatctttctccaggaaaaatctgtccttggcccaatgtgtaaacacttgctgagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcgtgaacttcaaagggcagaggggaaactgtcccttggcctctacccctccaaggccccacttttttgtcaacactccttggacgcagcagaagtatgaacataatatggtcctgaatgaggctgagtctttgggcgcagaagacccgggttaataaaaataggaaggtaagaaaagaaaagaaaaatcaagacacatcataggactaaattcctattatttatccactcaggattgaccacccctttgggccagatagttgtacccccatgtaccaggtgggcacatgaagacacaagaagtgctgtgatggttcattttgcacgtcaccttgcgtggagtatgc

SEQ ID NO: 10 - DNA, 1033 bp, Homo sapiens
aggaacttggaataacttgcagtgtcttgcagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcgtgaacttcaaagggcagaggggaaactgtcccttggcctctacccctccaaggccccacttttttgtcaacactccttggacgcagcagaagtatgaacataatatggtcctgaatgaggctgagtctttgggcgcagaagacccgggttaataaaaataggaaggtaagaaaagaaaagaaaaatcaagacacatcataggactaaattcctattatttatccactcaggattgaccacccctttgggccagatagttgtacccccatgtaccaggtgggcacatgaagacacaagaagtgctgtgatggttcattttgcacgtcaccttgcgtggagtatgccaactcattgtttggtcaaacactagtctggacatggtggtaaaggtattttttagatgagattaacacttaaatcagtaaagcaggttacccaccatactacgggtgggccctgtccaatcagttgaaggcattaagaacaaagattgaggtttcctaaagaagatggaattctccttgagactacaacatagaaaccctatctgagtttccagcctgttgccctgtggaattcaaactcaggactccggtctatgacattaaccctcacttaacttttcagcctgccagcctgccctatggatttcggacttgccagccacacaattccttaaaataaatctctccgtctc

SEQ ID NO: 11 - DNA, 786 bp, Homo sapiens
cagttttcacaggcctgtgtgccgagagtgttccttaccattttttcattattattctgctaaggaggatttttagacattatgttcctagtcaagccctcacctctgcaatgaaattataataccactgttgacccaaagatgagcagcaagcgctagaactgagggaaatcatggtgagatttattctgagccaagctggaggacttaggcccaggaacacagaatctgtgtccactgagaatgtatctcaaagcaggctccatgaggcaccgtgcacttacattttctaacaggcggacgtatgtggcccagaaggtgggagaggcaagcggtgagcagccgtgacgttcctgagattctgatgagcgctcggtggcactgcccacatgataagggagacatgagacatcaatcaacacatgtaggatgaacattggttcggtctggaaaggcgggacaactcgaagcaaaggcaggaagactcgaagcagacgggggcttccaggtcataggaagtcatgagcgaagagaccgtgagcctctcccaaaccccgcatgtgctgacatctccacgtgtgctgtgtcctgggtaggctttcttcatagaccgtgcttccgtctgtctggagtttccgcttcatccatctgtccacagggaggacgcacacccctgagtccgaggccacaccacgcattctgtagaaactctcactgcccagggagcacactttattaggaaagctccaggttcacagaggctctgggctctctctgggcccgacg

SEQ ID NO: 12 - DNA, 2680 bp, Homo sapiens
caagacagaggcaagcagagaaggcatagcagcagcgaccggcgctctgttttcattttccactctggccaggggataaactggaccccagtggactccaacaccaactctctgcttcccagttactttcgattttctttcccttctccttctttctctccctctctggcattcaaacagaagcacaagaggacccaccagtggcaactctaagcctccttgcaggccacattccctgctgacgtggtccttcctgcaggagagcccttctgtgattatctaataatagccagggtggctgagaatagaatctggctcaaggactctgcacacccggggcagagacactgaatctgtgggtcagggcctggcaacattccttggagcctccccctctgagcccactctttgggcacccttaggcttgcctgccccccttataaggggctttgtcagccctgccatccgctgtatttcatgtgctggttcctagctaaggagaattgggcagagcaaaccctttctcaccctggtctgacagttgtgatcccgacagaatgcgaccttgtttggagaaggcgaccttgttgggttggctgtgttctgaaaccaggcttgggagtgttatatatttattatatacaggcttaaatatacagactcaggcttatgcatgaatatatacagactcatatttccttggtggttaattgtatattaccatgcctatattcgctcaaacaccattttatgttcatgcaaaattttgttagtcctcactagatgagagtgggctcatggaggcaccgggtgcactgagcaggccctctgtgcatgctctgctggaaatatgtgctcactggaatcggagtatgcgggttccagtaaccaatggatgccataaaggctttctcagaccttattgcttttgttgcccaagcagctggactggggaaatactaaatcccttctgctttctctccacacctcctggcaaactctcccaacttagaaattattttacaagggagaccagttgtcttgaaattgagttctgcgggattcttttcacgggcatggtggggctgcaagcagttcggagtagtcagggccctggcgctggaagcctcactggagcgatgaagggatcagagtggttaataaggtggcctctggacagtgatctggggcagctgctggccagggtgcttggagaagcttgtggaaaaggcaagccaaaaggggtagggatgcagtgaatatctgtttctccccctgcttgccccagccggccgctcaccccgccccagcccgatttgcctgcatccgtggcggcagattgggagttctctaaggtcccccaaatacccagatctggttactggatgaactgcgttttaatcctcgtcgctatctgagccaggacaagacctggtcagggagacggctggtccgggcagcacgggagaggacgctggacccgctgcctgtggcctggagcactgagtatgggctaccaaggctgagaattgatgggcctcctttcccagcctttttcccttccagagacacaaaaagacagagcagaggggaaatatcaatgtcagtggaaaaccccataaaagaaagcagggaccagagcggggctggaggggttttccgctactctctctaggtgatcgggttcctcccaagactcttgtccagacaggctgcaccaagaggtgtgcagctttcttccaccttcctcccgcccttcaaggagggcagccttaggctttctgggccttggtcaccccaggcactggggtgacattactccaggattgtgcccctcgcccagcccacggcctctgccacggcgccgcagccgctcctgtttattgtgtctgtgagttgtttacttgttttgtctgctgccaccctgcgtcagaaacccgccaaaccagcgaactcgcccaggagaacaaagtgctgtgctatccccggactccctcccctttccagcaaccccctcctgccctcacaagctcctgcattctccctttcggaggggaggaagcagaaatagtcttaaaacagggcagctgtttatagggtcaggggaattatggggacaccataaacctctgggtgtccctgtggtggacagacttctgagcagcccttcccttgcctaggcttttcttccttcccctggtgaccacttggttaagggggccacactcattgagaaagttgagcccacccccatcaacccagtcccccactaccccactcctttctgcaggagtttccctgagacacaggttgttgggttttaaatcagggtaatgttggtggattcataaagctagatatagcatgtcattcttctcccacactccctctcctcagccccccaaaattgcagtgaatttaagcaaatcctacaaaattaaattgcccctttgctaaagatcctatatgtctccaatcctgccaggtgtagagtcagatagttggcttttggcctttaattttgctgctagctattaaatttaaaagagtatcattgaagtaagtaatattctcatttctgaaattaattttcccctcccagtctctctctctctctttttgccagcacagattaaatggttctttcagatctgcaaacaataaaggataaaattattta

SEQ ID NO: 13 - DNA, 2422 bp, Homo sapiens
ggtaacatgaaaataatggatgagcagttcaactatattaaaaataaacgtggttaagagtgctcaccttaagtgtaggatttgaaagtgtaggctctaaagtcagactgggttcggaacctggtatcattactgacttggtgtgtagcttctctatttctcagtctatttaacctttctcatccagaaaatagtgataataatgctgtttatctcatagagttgtcgtgagaattaagtgagttaatttgggtacagtgtttttaacagtcaggcacatggtgtgtccaacaaatgttggctattagaattgtgatggtttctcctatagttcgagattttagtctctgcaaagtaaaagacttagaggggggaagctgcccctttcagatgtggtgtggcatttatttccaagtgcacgtgtgagtcttctgtcttggtaactctccagtgtggtcattagtgttttccagttggttagtgtgtctcttctcttccaatagcaagataggtgtttcaaattcctagggcttctatcagcacacatgagggggcttctgtcccttggtgagcactggcttgtttataagcctacaaacagcactgtgtgctcaatattctgtctgcacctctagatttacctccattcttcaccctgatttttgcccccagcaggctgacctctaaggatcccctggctcctgtgccttctatattctggttggagtcaaagggagttgcagggaggcaatcagagagcaggaggagagagatgctatgggattatctcctccaccccaacacattccttttcttctgggctgcagtctggcagcggctgcattcctctactaaatgccacaactcctttcaagtggctcctgtctgacaacttcctgctgggttccagtggctgctctttctcttgccccttcagatctgaaggactcctctgttttctagttctaggtactgccacttacctgttcccttatctcttgccacacctcggtagtccctttattgaaagttcttcagctatcctctttgagcacactgtttcctagctggtacatattgaccttgagaaggttgatgcttcctcacctacttactgttgggaagaaaatggaatattttaactgctcctgcaatgtcaatacagaatcggccctttcaaagtccagtgccataggatatgaagagcattgctagaacagcgggacatgaatgttctacgtggctaaatacaatgatctccagtataaaaacccaaatggtcaaagatgaactcaaaggattggagtgaacacaggttttattattactcttagaacactctgggttataaaagaacttacattctttaacataattctgttgttttgatactaacgtttagtgcccattggatggcagtgccaggaataaaatgtctgaattaagctagtgggggtgattgagtttatggccaggagctacattggagagagagccatgtcagtagcctaacactggcaagacagtgacccaagtactctagacttggatgtttttgataggttctttggaaaaacctcttctaggtcgttaagaaagtttgaaaggctttagtggtttaattagataaaatgtagcagaaggcaatataacataggcacccatagaaaggagggcaatggtttataagagcttgactctggctcacatctgagagacaagaaaacataaatccttcagtcagatccttttatgggacccactttcctcatagattagtttatgtaaaaactccagtaaagaatagcacagagacctctgtttgtatgtttgatgattttactgttagggttttattacttggttcatgtgcccgaggaagtgaacgggtccatgaaggatatatttgtgaggttaaagccacatgtagtttatttaacttttgcagttttccaatttgggtctatatttcaaccccgaattttctaatttggggtctacatttcaatcaaaaagattaaatttcttttcctctgtgtttgtggatctctctgggcgccacccttaaaattagcatcatggttcccatggcaactaacgtacctggaagatggcaagaaaggaaaaggactaaataaaatagaatgaagctgcatctgaaaaactggaattaattatgaacttgaacaaagggttatactgcaagtggttggggagatgagtattaagcatataaggtctttgctttaagacctctgtaattcacttaccatttcattactttgtttattcagcagcccccaaatcactgctagttttcttttccctctcaccttcaatagagaacatcattggggtcaggactgtgcatagttcaggacgagtttacctctacagggtgcattttgtaagatgtccccaa

SEQ ID NO: 14 - DNA, 830 bp, Homo sapiens
tgaagcccatgagccactagaagccacatgttctgccatgtggagaagaatgagagagtacatcctcaaattgaggtgtggcatgatgatttggctgcccagaggagaacctgtctttcccatctaaagtgggaggtcaagccaagtagagggaaacagcaactggagagcagatttgcaaaccagaaaagcaactcatgaatacaaattgcctggaaagcatttattacaacagaagctctgcaagatataccggaaattgacagtggcatcgaattcccagcaaggaagttttctaaggacaccaacagacaccagcagaagacagccttgcatttacaacaaaccattgatccacaacaaaccattgatccacactttcaaaatcattgaggtgaagcatagagaactggagtggagacggctctggcaaatccaaacaatatcaaaagcactctcatactgaaaacccacagtgctgaaccacagctgagatgtaaaatatttcacaaaatcttcttcaccctctatagtatttcacctgagagtgcatgatttaagttgcaagcactgtcatagatgatgggattcagagatgaacacatggaaatggactttatgttctctaatgtcacaaagaaagagtgattatgaagaagacccagattcccacctattaatctgagctttgaattctttactttgctgggtccaccggattttttctccactcagcccatcgatgagagtggaggcggcctgcatctttttccggcacgtatcagcgtcattaagcaaatcctgcagccataatgggagaatgtctcaaa

SEQ ID NO: 15 - DNA, 383 bp, Homo sapiens
ctttcaagggcctgtgcctgtggtaactgtctatgagccaggtatatctgaagcatatttgacaacagaaaaagttaatgtaattttcaaaggaaaaacgccaacttttttcaaaaaggctggatccagctcttcatgaatgtcctcaatgagaaggggtcggcccaaggaaaggctgtcctccaagtgtgtgcgaaaatatttatggttcagagatgtcacctaaacagaaagaactcattggtctatctgtgttacaaagaatgtgcccattgctaagggaaaccgagagatttgttggacaggtaatcaagaattttaagggcaatagaagaagacttacttaaaaaaattaaagtaacatacaaaaattaatttctaaa

SEQ ID NO: 16 - DNA, 753 bp, Homo sapiens
atatctgaagcatatttgacaacagaaaaagttaatgtaattttcaaaggaaaaacgccaacttttttcaaaaaggaaacagcaactggagagcagatttgcaaaccagaaaagcaactcatgaatacaaattgcctggaaagcatttattacaacagaagctctgcaagatataccggaaattgacagtggcatcgaattcccagcaaggaagttttctaaggacaccaacagacaccagcagaagacagccttgcatttacaacaaaccattgatccacaacaaaccattgatccacactttcaaaatcattgaggtgaagcatagagaactggagtggagacggctctggcaaatccaaacaatatcaaaagcactctcatactgaaaacccacagtgctgaaccacagctgagatgtaaaatatttcacaaaatcttcttcaccctctatagtatttcacctgagagtgcatgatttaagttgcaagcactgtcatagatgatgggattcagagatgaacacatggaaatggactttatgttctctaatgtcacaaagaaagagtgattatgaagaagacccagattcccacctattaatctgagctttgaattctttactttgctgggtccaccggattttttctccactcagcccatcgatgagagtggaggcggcctgcatctttttccggcacgtatcagcgtcattaagcaaatcctgcagccataatgggagaatgtctcaaa

SEQ ID NO: 17 - DNA, 13965 bp, Homo sapiens
atcccctctgagaatttatcagaaaaacaagcaataagtgagaccaacgttgtgaggtattaactcggaaccgtcatctatccttgtggagaaaaacccggaggacttggattaggacccaatagtctaccttggcggcaggtgagaatcacctggggagcttttgaaacatgaggctgccaggctggacctcactccagaccaattgaaccagaatctctgaggcggggcctgggtgttggtaattttcctttgaaacactccccaggtgattctaatggaatctaggagtgagaatcactgggggaaggcatttgtagatgggaaggctggtggcatctgctagaagacttgatgtgtacttggccagagataaaccacaggtctggcctgaatgggtgtggaaatgtgtcagtcatgttttcagatttccaaggtcattttccaagagacctctgtgagcttggactggatagcgcagcacagggccagcgatggcagctggaagggtggctgcctaggaaggaggtaagctttaataactgaaatagatgctgcactttcatctacttaattgctatgatttgaagtctcccatagcctgaaacgaggtacccaggggagggtgtgagagaaggggagggtactgagggatcctggggcccctagaccttatctcatggaaggtgctgggctgggtcagcaggactcaattgcctgctgcaaaggcctcagtgctccccagagatccggctccccacagaggcactgactgcaccacaccctgagatctcactgccggtctacagcaggaccattaagataatcaaagagtctctggggagtttgtggagcgtgactgtgaccacgggagcatattttattttgccttgaaccaaactgctaaggaagaattctcttacattttcaacagaaagagggtatcagtcagccaaatagccctgagcacacttctagttagctaacagcatcccagaaaaatagacctgaagtttctataagcagcctgtctccttcgagaccaaagctttctctcagtcagggatgttgttgggccccatagtaaatttggggagaccagggaaaatccaggctcaggagaggtaaattttcactgtgcttgaatcaggagaatctgattatcaacatcaacccttctctaaaatgaatttaaaccaacatttaaacatgcttcctgccacctgcccccactctatagaatttttcctcgactctccccacccccctactctctttccttccaacaactccatttcaaccacacgcacttgatagaatatcacacacaggcacatttattattgaccagcttctttatctcggatagtatgtcatgagtagtcaagactatagctcttgaaggtagtttcatagatttaagatgaagaaacagtatccatatagttccagagtcaaggtagtctaatagccagtgaaaaaatacaagctgttggagagtggaagtttactcatgggagctggcttggactttagatatgaaacatttgatttatagtttctatttctctctgatagaaaactctgctaacccttattggaaggtcgaatgtgttgggttctttagctgaggtagctgttaaaatttatttcacattcaaggaaaggggctcttgttattaaccatgttcccattttaattatgattttcctggcatcatttttaacaagaataacctaaggcctgcaaggagtgatttcccctaatcacttcttaaaccctccctccccacccccaactaactgctatagctacagctacacagatgaaatgaaatggagacttgagcaattacctggtggatctgaacagtgtggagtcagcagtcaattagaatagttcaattacaaaaatccttttttctcccttcttcttttctgctatagaattatcaccttaactcttcctcctccacccaccctgtgttgaggcctcctttctcatccttctgcttccgttggccccagacccctctctactggatggccctggctcctctgccagcctagccctcatatctattcctttttggggagaggcctcgaattcctcctctcccaattggatgggcttaagatggggaaccttgtgttacgctgacccctgaaccctcacatcatttcccaggtgtcagtgtaccttcagaaagcctgtgcctgaggtcctgagccacatccccctggccttccatgttgctattctgagattctctttgcacaccccgttggctacccagatccattcacctacggggacactacttattcttgccagcttccttcaccagggagtgagcctgaccctagtccagtatgatgagagtgcctgcccccagacacagaagtcacagatatgggtgccagtaggccttctgagtatggctgtacctcctgccaactggggctccaaggacttcctcttcaccacagtggcaaacacttgcctggatgttgattacagatagatagccagtcccatctttggatgattctcactgtcagccatgtctttctccttagcagaggtctcaagcacctctcctctggcatgtcttgctgggaatatgatccaccataccagatatgtattcatctattcagccatttaacacgtgtttattaagcacttactatgtaccaagctttctgctagatgctggggaaaacaacttacaaacccttatttactcttacatacgtattcatatgtacctttaaggaatgagtattaatttgccagcaatgccctaacaaaataccacaaagcatgtttaaacttggcttaaacaacaaaaaatttatttcgtcacagttctgaaggttagaagtccaaaatcaaggtattcgcagggttgcttccttctgaggtctgtgaggaagaatctgtttcagactggaacactacctttcaccattaaacaaaaattcactcaagatggattaaagatttaaatgtaagacctcaaactataaaaatcctaggaaaaaacctaggaaatactattctggacattagtcttaggaaagaatttgtgactaagtcttcaacagtgatcgcaacaaaaacaaaaattgacaaatgcagacctaattaaagagctgcatagcaaaataaattattaacagagtaaacagacaacctatagaatgggagaaaatacttgcaaactatgcatctgacaaaggtctaatatccagaatctataaggaacttaatgcaacaagcaaaaaacaaccccattaaaaagtgggcaaaagacatgaacagacacttctcaaaagaagacatacaagcagccagcaaacataaaaaaatgctcagcatcactaatcatcagagaaaatacaaatcaaaaccacaatgagataccatctcataccagtcaaatggctagtattaaaaagtaaaaacaaaacaaaacaaaacaaacagatgctgacaaggctctggagaaaagggaatgcttatacactgttagtgggaatataaattagatttccaccatggaaatcagtttggagattactcaaagcacttagaacagaactactattcaacccagaaatctcattcctgggtatatatatcctaaagaaaataaattattctaccaaaaagacacatgcacatatgatacagaacatatgatgcacctatgttctaccaaaaacaacatatgttcatcacagcactattcacaaagcaaagacacggaatcaacctaggtgcctatcagtgggggattggataaagaaaatgtggtacatataccccatagaatactatgaagccataaaaaagtgaaatcctgtcctttgcagcaacgtggattcagctggaggccattatcctaagcaatttaatgcaggaacagaaaaccaagtacggcatgctctcatttgtaagtgggagctaaacaatgggtgcatagggacataaatatggcaacaacagacactggggactactagagggaggagggaggagcaggacaaggacaagggttgaaaaactacctgttgggtacccacagtgtcacacaatatatgcatgtaacaaacctgtacatgtactccctgaatctaaaaagttgaaattatatatataaaatgaaagtatagaataaattaataatataatccactgtataaaaaaaaaagaaaaaaatctgtttcaggttcctcttctaggattgctgatgaccatcttctccctgtgtctcttcacgtcatctcccctctatgcatttctttgtctgtgtccaaattctcacttttttataaggacaccagtcatactggattaggagcccaccctacttgtgaccttaacttagtgaattacatctgtactgatcttatttccagataaggccacattctgaggtactgggggttatatcatttttgggggacacacattgttcaacccataacagtatgcatcattttatggggcagtaatgatagagatgtatatgtacagtgcagacctagtaaagggagtagacactttttttttttcagggcagacacatcctcaagaaagctaatatgaagccacaactatgtttcaggaactatttttgtttattgatcacttattatgtgctaaacaccatttagtaatttacgtgtgtcaacacaatcctatgaagaagctgagccacagagaggttaagtaaacagtcccaatgcacataggaaggggcagagtggcagatcaggtgtattttgcaggaactgaattacttatactgtcttcccctacctccctgaaacaccaggctctgcccattgaggatctgtccatagtttaagaccctggccctgacagggaccagcttacatggatgattaggcgtgaaagctgtctgagtcaggcaaagcagaagcctcattgtgccaaacttcctaatccccttggtcagaacctctgtccccatgcacccttaaaataggcactttccagtctatttcaggtgctgtttattgtcttcttggtatctttcaaacacgattatcatattcatttggttatctctagagtgtaagccccatgaagggagggacttgtgttgtcttctttagtgctgcattgccagtgcctagcaatggcccagagaggcattccagaaagacttctggtaaatggattgtgctatatatcagatttctttggggtcttctcagaaattagacttcattaaaaaaataagccctaggtgaaaaatgcctctacgaacttgtacattaaattactgagtaaaaatgaggcacttaaagcatcacagctggtctctagcccaggcatggaggccactgaagatgtggctgtctgcaccaaagtcatattactgaattcattgataattatcctaagtggagcaaatagccctcatacaactcttgagcatagctgtaagttttattttcacttaaagtattgacttcccatccagggatccatcatcctttttttttttttttttttttttttgtaacagtggcccactcccattgctttgtggaaacaggccacgcgttcaaggcaaacttgactgtacagagctcacagtggggtgggtacttcacggacactctctgaactgctaaggtggtagagcaaagcaggtggagttgggagttggaaggcctgtgtgctcaccctggcccacaggcagctcataatttatgttgagattgggtatcccacttgtaagaaggagtaaataatttctgccctgtttgcctcacatactattgcagggttcaattaagttaatgcacagaaaagcacttcggactcagaatttacatatgtaaagaataattacctgggagcaacgtggcaagaacaggagtggtggcatctgatagacctgggcttaaatcccagttctactcaccctgctgtgactttagttatctataaatctctttgattttttgtcatttgttttatcatctgtaaaatggggagaacaataccagccttgcatgattatgagagtcaaagggaataatatttggaaagttcttggcacatagtaggtgcagtggtaacttttttgctgctcattttagtttgtcacttaatcagagagtgtcattgtattagttttctgttattgccataaactatcacacacttagccacttaaaacaatacaaatttatcatcatgtatttataggtcagaagtccagtgggcttggctggtttctctggccaggtctcacaaagttgaaatcaaggtgttggcaggcccaggggattatctactttcagacttattcaaggcattggtagagttgagttccatgtgattgtagaattgaggtctcccagctggtggctggggattgttttctgtttatagagaccacccacactacttggcttgtggtctcttcccccttcttaaaagccagcaatggtgggttttgtccttctcattctttgaatgtctcctctgtttcccttttctgctgcagctgactcttctgtctcctctacccctttaagggccccatgattatgttgtgtgtaatttcatctgcaaagccacgtaagcatattgtgccaaggtaacacattcacaaattccaggggataaaaacatgaacatcttttgctgggggtggggtggagcgggattattttttctaccacaaccatatgttgatatccgatgttctcatattattaataatgtctcctcaacaagatctaatattcaaagtacttagctcaatgcctggcgtagagtaagcgcttggccaatattagtttctatttttgttgttggtaagcagatgacaataagtatcttgtttttttctacaggttctagcaaatccacctggctaagggatgcatcttcctttactactcattgtcaattctctccagaaagtctttctgaccccagtccttgcccaccaggctggattcagtgccagtcctctgtgttacagcatcatagaacttcccttgttcagctgtccattaccctataactctttcaccagattgtgctttttgagtacagaaactgacatttctgtatcatttagtagagtgtctggtacatagtacatgctcaagaaatgcttattgaataaatgaatgatgggaaaatttattatatacttaaaaatttttgatcaaataattactggttggaaagtatcccttaaacaacacaaatattgaaatattcagtgagaggaaaatctatgcatatcaatactgtgcttcctgagaattatctttacacagaagacttcttgaaaaataaataaacattgtgtttgtgaattgtccaggcctggatcttgaggaggaaggcacttctgaaatagctgcaactcccggtaagtattgtacttggaattcactgaatgattgtgacactttttttttctgaatgcattagggaacaaacaaagagagtattgaaataaagccacatcatcttggcttctcatttgcttccttactgggacttattatatctaacagcaaaactgaaccctagtgttatttctcttggaaattcacgaggagctcttccttctgttttttttttttttttttttgtctcacacattgaatactcattttctgtccattttgtgaagtgtcttaacaatactgcaagtagttagtgaccaataataatcaaataagagcaattttcatagggccattaatattgccatgtgtgttttccatattttagaagtttctcaattttggtttgtcagcctgcccatgtgattccagatcagccaaggaggccaggctcctcttgcttgggccaggatcacttaacagctgttttgagcttggctggtctttttgcaataattgctcccactaagggactttgatcttttgatatttatttttagatacaatatagtcaccattattttaaaggaacagttttattatctgaaacaaacaaccacaaatgaaaaattggagccaaatcacaggcctcaggacccagatgaggaataaagaaaaattgtttatagccataaatgctttctttgcagctttccttctgtctattgggctgggtcacattttctaccatcacagaatggtgattagacatcagattatatcttgatattacaatggtactgccctctattggaagtctgggaatcctaatttcctttggattcagtgctccattttgaaatcacagtccagctcaggtagcaggctcacatataacatcgaagggttgcaatgaagtaatttctcaatggctcctctggttgaacatgcttgcacaattattttaaactcagcaaacatttgttgaacacctatgatgtgccagacattgtgcaaggaactcaatagatgcagagatgtctaaaacacggttcgtgatttcaagaatcttatgacctggtacaggagacagacttttatataaataaatagaaaggaatctgacttcatggagttctgcaattccaaggaattttaagtggtatgtgggcagatgcatggccaaggagaattaggacttactactggaccagtcattggctcagtgcctggcatacggtagatacttcataagtggggtatgcatgatttggagaaggtgatgtaattaggacggaggggtctggaagggctgtacaggaagggatgcagccagagcctcactgacatcttcctctcctgctcatactctgagcaatcctagaaccatggtggatgactttagctgcagcacagtacgagaacagagtgatcaggagtgatgcactgacagagcatccagcaaggcctctttcattaataaactattaataaacacaacagactgatgtgccacacatagcagtactatttgagcctgaatatgcctatagggcagcacaccttgagtggacagtgggtgctaaagagccatttatacaagtaatgtcactctcttgcctgtcctagagttcttgctccattgtaacctctcttgaggaattcactcctccactgagtctctgaaaaaagaaaagctttatctatcaatgagcaagctctatagcagggtttataggccttccttgacctgggccctgactaccatctctatctcctctcccagaactctcccaccttcctccaaccgatccaagctgttattagtttcttctcacactttcatgcctttgcactgcctttccctctaattggaatagtctagtttttaatctaaagtttctacttattctttaagacttagctcaaaggccacttttttttggaaagcatttctttgcttttttagactacaaaaacatcttctgaatctccataacactaggtcatgtgtctgtcctactgcttactgcaattctccaactatttggttatatatctgtttccctagaggtcaaatacggtgtcctattagtcattttagccccagggggttaatatattatctggaacatagctaacattttgtgaatacttttctaataaacgaagtggatttggcaaaaaactctgtgttaagaaaggtctagtgaaatatttttcatctttcatttataagtatctataaggtaagataggcccattgtccacaatctgcattaatagatctcaataactggcaaaggaagaatgctccccagagaccaggagagagaaaaggccaagtgggcaaagccagggccctctttaacagacagggaggacagaaaggatgggaacccttgttcataactgttcctgtgaaatatcccacaaaaaggaatctgtgctagaattattttgggaaatgcgatttactcttttctatttcattatttactcatcctattatttaacaagtatattttaaatgtctactatttgccatacattgttctcagcactggaaagatggcagtgaacagcataggtcatggttcctgccctcccagagtttacattctagtgtgagacacaagccataaacaaaataagaacttgaactgggcagtgttttacagaggggtattaagtgctatggagaaaagaagtgggaaagcttttattggaagtggtggggagtggagtatgggaattttgaataagaggtcaaggaagttctcaccaaaaggttgcatctgagtaaagacctgaaagaagagaaggagtgaggtaggtggatgtctggctaaagagcaatcaggaaagaaggagctgtgaaagttccatgtttagaggaacagcacagggcccagtgtattttcagcccaggaagggagggaggtgaagatgggagatgtaggtggagaagtcatagaagagcaatcatttggggttgtaggtaagaactctggatttcatctgagtaaaaggggaaagccattgcaaggttttgaagaaagaggtgatattacctgttgtggcaagtgaggcagtcaacctaggtgttgggctgagagtagactatcggtgaagggcagaggcagggacaccatttggaaggcttcttaaatggtccaggtgagggaagatggtggcttgggccagggtagtggagtaaagtggtcaaattctggatatattttgcatgtagaatggataggatttgctgatggatgaaacaggaggcgaagaagaaatagaggaatcaagaatgacattaagatttttggcctgagtaacttgaagaatgaagttgacatgaactcgtggtgggggaagactgagtgaggaggagttgaggggatatcaagttaagtttcagacgtttattagacatctcgtggaagaccatgaataggcagtcaagcaatcagaggacaggtatgggcaggagatgtaaattgaacagtccttatcatgaagacagtatttaaagccaggagactaggagaggtcacccagagtatgaaagtaggccaggaagagaagagaagagaagagaaccaagaactgaactctgagatggatttagagtcccagctcttgaattctcatctctgacagtccttgaagaaaagaaacaggtttaacttggcttttcccaatgtatcggatgatggaacaccctttcccctatagaactgtggaatttatgttccactgaacactttttggagaaggccactctaggcttggaagttatcctagggccataagggaaagccttttttatcctctactaagaagtttggactttgtctcccaggtgttggtagttcaccagtgaattttttttttcttcaacacaagaatagtggtgttctttatttacctttgcatattttttttcttctctgaatttttttattatactttaagttctggggtacatgtgcagaatgtgcagttttgttacataggtatacacgtgccatagtggtttgctgcacccatcaacccatcatctacattaggtgtttctcctaatgctgtccctcccctagcccccaaccccccaacaggcccccagtgtgtgatgttcccctccctgtgtccatatgttctcatttttcaactcccacttacgagtgagagcatgtgatgtttggttttctgttcatggatggattttaagagaagtaacaggatttacatattttggtggcagtatggaaagtggcttgtagaggggagtctgatggaataagacaagagaatagctgactgcagtagccttggtgacagatgatgaagccctgaacatagcgactaggaatggatggaagaatcagattaaatgggtatttaggatgtttagaatcattaacatttgatgaccaattagatatagtggatgatgaaaaatattcaatgataatcctgagagttctgtcttgggtcagattgtctatatttacctgtatcccttagagagatctatcaatgcaaggtacaaagcaacattccatgtaattagcttttatttttaactctgttcaagttatattttaacagaggaaattgtgaattgatttaatgcccaatgttgccttctatttttgtcattcataaagccatgttagtttttttattaatacaaaaatactttaaaatggtatttacttgagtaagcatgatgaatcgtttgaatgtgcagaggattatgatgttattttttaaacactaatagtcatattttgggattggtgtgttctaatcttttacatgcagagtacagaattaaaaagaaaacagattatactgactagaaaagtgtttctagaaggtggtttaaggaccttgtatagattgggccttgttctccaacactgggaaaaggtgggagaaatttccaacattgcttcattgcttatctggatttttgtatgtttagaatgggactaagaaatgctggaatttctctgaatactccaaggactctggaaggaaagtacatttctataatgtggctgtggtatgtgcacaccttttgccttttaaaacagccttttgccggcattaatggcatctcctgaatatcttgggtttgaagctgtgaattgagaagcagaatcaaattgtttagggtcatgtgaatatcacatctttactactaataaagcacagaggaaagaccttcagttggacatttaaataattcctaagacaaaatcaatgcttttttggtagtaagtatttgtcctattcacaattttttttcttgttttctttcctctaggcacattgtagggttgaacttccctgtttgcattacataggactggtcatctgactggctgtggccagtgaaaatgtagatgaaaatagcctgtatcacctctggacgagtcattaggagtcagtgtatgatttgatacatttccttctctctgccatggtgattggtgatggaggctctattagtttttgttcctgagtaaagtaatgtgggtatgagtccctagctgacttccaatacgagtgagaaataaaccttaattgttttaagcctccaagctttggagtttgttgtacagcccaccatgacaaatatacttttagtcctttatttacatgctttaaaatactgcttgcattttctgattaccatatgttcattgtggagaatttcaaaaaatataaaaaaaaacctttgaaatcacttacatagaaatagtctctgttaatattttgatgtattgtcttcctctcccaatttaaaaaatcaggatcctaatatatacgatattgattttttcacttcatatatactcttaaaatacatgaatttgctgcatattattaattgatgaggaagtgttataatctatttttatatttatgttttatatttatactatacaattcataagagtcacattttatttttgtactttttcttgttgtaaataacattccaatgaaacttttgtgattaagtctttgctcaaattgctgctgctgtccttggagtagatccctagaaggtgaacgactaggtcaaggagtatgcatacttttaagatttttgctacctattgccaggagaaaggttataccaattaacacgtcagctgtgtgagatgggccatctcaccagtctgttgagtattagaattccttttaatctttgttaatttgataggtgaaaacgctatcttgttttatatttgcatttctttgattacaagtgttgttgaacatttatttcgtatgtttatgagtcatttgcacttttttcttgtgggaattatctaaatggattctcacaccccccaaacaacaagctaataaacggaaagccacacaggaagccggcagtactgttgccacggagcctctgcacgagcttttgaagtgtcagcgttgaacaggttcctctaactccctctcatctgccttgttttgattattttctctccagctgtatccctccacagtcca

SEQ ID NO: 18 - DNA, 2218 bp, Homo sapiens
ttctttttgtttgctgccttccgtagaagatgtggcttgctcatgcttgacttctgccatggttgtgaggcctccccagccatgtggaactgttttcaggtgctggttccatggctcttcctgagccgaaaataaggaaactccatagaccttgtccactggaactcgttcccatctaccctccactctatccagggtgatggatctctgcagtaagtggaagagttcttcatggcccccaaggttatatccatctagaacttcagcacgtaatttcatctggaaatagtgcctttgcggatataagttaggtaaaactgaagatgagatcatactggattaggatgggatctaaatccaatgaaaatgtcttcataaaaaacaggaaagaacccatagaaacacaaggaagaaggtcatgtgaagatggaggcagagattggagggatgcagccaccggcccaggaatgccagcagccacccagaagctggaaggaaatgagggattctctcctagaacctttagagagaacatggtcctgtgaacagcttgattttggacttgcccatagcttgtatactcttactttggatacaattttatccaaacttggctaaacagtttctcagcctatggaaaatttaaaatggagaagattcaactcgattcttacagattcaaagcaagaaaatgatgggaacataggaggagaccaagaaagcctataaaaagcaaaaatatgaagtgaacattgtggtagctttaagatgtttagtgtagctgcaggcaccctatacacatgaaaacccccaaggggaatccccatatcacagtgtagtgtgatatttgacattcgtgatcatctagagatgtacagaaaaggtgaatctgtgttctgtatattctgcctaaggcaaagaaatgtttagctctctttaaaatagttccataattttttctaaaaagctttgcttgaaaactgtaagcttcccatatctggagcatttcactttaaatatttggataaatatgttatcttcttacttggacatttcatgtgtttagggattgtcttctaaattcttcctaattcatatagctgctaacacttcccgcagagctaaaccattacagatatgaaataaagacctattgatttgacttacttttacttgtaaaaccttctgagtgttataacctcatttaatctttcagcatttacagtttcaagagtttgtgtcacaattagaagaattcagctgcacctccaagtgacagcagttgctctggttggtgggtgatctcaggaggcttgagaattgctttgtctgtgagggaagtaagacattttcagagccccactttagaaggtgtgaactggctagataatgaaccccagggctaacgctgctatagcagtgggaaggaggtgatgggttttcagtttggacctcaaacatcaataccctcctggtacggggaggaacagagtccctcctttacttctccattagaaagaatgagatggcaagacaatgaaacaggcaaagtgaacagagatgcaagacaaaattcaggtgagagagccagagcatcactcagccattcctgacatgtaaaacaggcaactagaaatttgcagaaaggaagcgaagtctccataaagatgtttttaaagtgagcttgaagtatttggagacaattcagtgttacataaaatctgcaaatctctggataaagaagcagagatcccagcatgggacaaatggagcctcaaaagtgggaagaagacagagaagaccagggcagaatgcatctcttcctttctcttggctttcctggataaggactgcatcattcctgtggaaggacaggccatcagctccgaaacactgtatgtattttccagtatatactgctagctgtgtgatgttgggaaaatttgttaccctgtctaacccccacttccctcatctgtaaaatggaaataatgatagtacctacctatctcataggtggcaactacaaggggcagcacactcagggaattaaggaagtttcagtgaacatcaactttatgaacacagtgttcataaaggcaggtcagtgcagtggtttgggagccaggagaagcacgtgggccggagtgtgcctgcaggagacaaggtcagagatgttgctaataatggagaataaaggatgcattctcattactga

SEQ ID NO: 19 - DNA, 465 bp, Homo sapiens
aggggtttccgcttttgcttcttcctcattttctcttgctgctgccattttcgcctcccgccatgattctgaggcctccccagctatgtggaactgtaagtccagttaaacctcgttttcttcccagtctcagggtgatggatctctgcagtaagtggaagagttcttcatggcccccaaggttatatccatctagaacttcagcacgtaatttcatctggaaatagtgcctttgcggatataagttaggtaaaactgaagatgagatcatactggattaggatgggatctaaatccaatgaaaatgtcttcataaaaaacaggaaagaacccatagaaacacaaggaagaaggtcatgtgaagatggaggcagagattggagggatgcagccaccggcccaggaatgccagcagccacccagaagctggaaggaaatgagggattctctcctagaacctttaga

SEQ ID NO: 20 - DNA, 555 bp, Homo sapiens
aaaagactatctcttcccattgaattaaattggaactttggaatcttaatagaaaaccaactgacttggcttggttttcaggtgctggttccatggctcttcctgagccgaaaataaggaaactccatagaccttgtccactggaactcgttcccatctaccctccactctatccagccccatgaggacaaggaacatgattggttttgctcactgccgtatcttccgtacctagtacgtaacaggacatcaataaatattagttgaatggaagattaaatcaacaaaatgggtgatggatctctgcagtaagtggaagagttcttcatggcccccaaggttatatccatctagaacttcagcacgtaatttcatctggaaatagtgcctttgcggatataagttaggtaaaactgaagatgagatcatactggattaggatgggatctaaatccaatgaaaatgtcttcataaaaaacaggaaagaacccatagaaacacaaggaagaaggtcatgtgaagatggaggcagagattggagggatgcagccaccg

SEQ ID NO: 21 - DNA, 501 bp, Homo sapiens
cttgctcatgcttgacttctgccatggttgtgaggcctccccagccatgtggaactgttttcaggtgctggttccatggctcttcctgagccgaaaataaggaaactccatagaccttgtccactggaactcgttcccatctaccctccactctatccagccccatgaggacaaggaacatgattggttttgctcactgccgtatcttccgtacctagtacgtaacaggacatcaataaatattagttgaatggaagattaaatcaacaaaatgggtgatggatctctgcagtaagtggaagagttcttcatggcccccaaggttatatccatctagaacttcagcacgtaatttcatctggaaatagtgcctttgcggatataagttaggtaaaactgaagatgagatcatactggattaggatgggatctaaatccaatgaaaatgtcttcataaaaaacaggaaagaacccatagaaacacaaggaagaaggtcatgt

SEQ ID NO: 22 - DNA, 10817 bp, Homo sapiens
ctctttctctccttctcccttccttcctccctccctccctctcttcctctcttttctttctttctttctctttctttctttctttctttctttctttctttctttctttcttttcttcctttctctctctctctctttcttttcttttctttgctttcctttccttttcttttccttttttctttccttcccctacgtggcaaatccagggttgggctagccaagaaaagtagtaacttagcaggtctaccactgacccctaggagatccaaatatgttattttatatatctttaagtacagggatcacttgcaaaaactatcctgatattattaacttttatggagaaatcctaacacaagtctattttacaataaggtgttgtatatcacatgtaatttattgactactgcagtgaaagtgaaaaactgaatggctgtgtgaatactcaaagtatggtttctactgagcatgtatcactttcacatcattgtaaagctgaaaaatcactaagttaaaccatcataagctggggactgtctgtatattctcattgaatagttttattgtattactattttataaaactaatatatttttctccaaataagtgactttacaaagatgaattttgcattccaaagtatgttatatgttttatttattagcaaaagtatgaactttggagtcaggtagatttgaattaaattccaattatactagaaagctctatgactttggtcagttatagtaagaattcccaatttatagtaattttataagcataatttttggcacttagaaaatgctcaataaatattgattctttgtgatatgatgataattaatgatacctataataacaaaggtgacgatggtgagagactacacttctctcttccatttaccttcagttataatgaaaggtaatgagtaaatatgactaagtagtgaatatatataaagtatcagaaatatttctatttaatacaatgcatcaaatggtatagtacatatattttatctgaaataaaagcctgaagtgaacaatttggccctaaccatataatttaaactaatcactattttgtaatttttactaatttagatgttgtagaaggcaacatatttctgagaattttttcttttgatttaagaaaaatgctaacatgagaaaaataattcttacttgattttaatgatttaattataattttttgataacttttttatctaagatgtgagcagctatgttttactcttagttttgaattctttgttagtttcctatttacatagttggctttcttatattatactaatatttataatcatatactgcagagattgggatggactcaagtactccaaattttacaggaatgaagtctctcccattttggtaaaatggcttttgattgttatttaatacaattcacacttgctgggatttagaagttttgaaatcctcatttcagtgacttctataagtttttcaactgatgcccaaagattagtgttcctttgcctccattcatttaaccaaggtgtagaacagggtaggccagagctgaaggaaagacagcgctggagatgatgctctgaatggtgcttgctggagccacagataatctgaggatgctgcctttcctgcttcccaggagctgagctagtggaaaaaagggaataagaatgtaatttttcttcagatttaaaatgtctgataacaaaagttgattaccctgttttatttggagagaaatccaggtgtagagaagatattatacttctctttgagactaagtacctttaaaatagttttagatatctggatttaattccatatgtttcaatttttctatatttatatgatagatacatttaaataaagcatgctcctctatatttcgctcaggattttggacagagctgataaattctttcactcatttactcaacatacctttattaaatgcttacttctgcaggtatttatacttaaaatcataatttacttcataaaatttaaaatctaacttttggagtcctcaaattgatatggtcttatccatttattggtaaaatgctgcattcgatacaacatacaaagtggatgcctgtggcagagcagttacttgccattgtctctttttttttgttttctctcccagaggaaacttcaggtttgggctgtttcattcagaccccttatgaccagggtgtacatttcccagactacatgtatgaaactcatggccatggaatagaacaaacacagttgctccataaagtctttttaaatacggtgttccaaccaactgagctaaacaatctcagactttgaaaagaatatgttctttgcttagaagaggagcaaactcaacagatttaacaaattttaatatctcacagatttaaaaaacaaagaatttcaaggttaaccgggaaactacaatatttttcttgaggctgtttaatctgagcctgcacttcagaagcgattttatgttttaaattttagggttctgacctgttttcctttctcaaaacaaacatgctaagagtttaaaatcaaccatgatcattgctagtaaatatgcactcagacctgacctggctgtgcaaataaagtccattctccatggtgatcagaagcagcaatgtctcactatggaaggtggctagctgcatttacagactgtacaatctaattcctccttctgtaaatgttgattaagctgaaagaggatcgttggcaaagctaattcaatagcaccgtctcctctcctgaaaggctggaggatgatctcactatcacatgagtccattagctatccctgcagcaaaactcaccatctggctaactggcttagactgtgctgattggactgcaggcttttctagcactctcttgtgatggtgagtgtgagagtaagaagctgggaggggcagctggacaacataagactgctgttatctcttagggagctaggtgaaccctaagtgctgcctgatagcaacaggacctgcctggcactgattgtctatttcttagcattggtaacagaagacatggtcatttatgatcaatatgatggagttgacaaattaaacaaacaaacaagcaaactcttccttctaaccctgcaatctttgacttttgatcctgtcattagataactgatgtaggaaagtcactgaagcatcactttaagtagcagtggatgaagcattttcaaaataacaaccggcctaagtcaaaaatcaaatcgatgtttgctccattattgttctcttatgtcagttctgatggtagttcctgttttagcctctcttggaattatagagttagaattgtgactgaataattgggaataagagggaaaattgagtattctgctgcctttgttgaatctcactccgggttaattgctgctaattatgcagctgcttattggtgcatttctatccacttctgcgtctgaacacagaaggaagacgtagggaggatccaaagtgagactccaacaaaacagctgatcataacctgcatgtaaaattgagaatttgttttcttttgcttttattttacattttttttaaaattatggttcaataacagaatataatcggttatcaaaagcaatgacattctgttgtcagcatctgagagttgttggtatgatcactgttgggtggaatgtttaagtattattcctacagcaaataagaaaagtgactctaattactgaagatatgaaataaaagatatgaaaagcaagattgagaaagaccttctttactggtccttattagtgttaaaaaaggccacactaacaaatcagggactgaatatcatgttgttcagccatataggttttgaatgccatgtggtggttagcttactttgacaggagcagtacagtcttactcgtttggcaaaataacaaatgttcccattattttggattatatatttatttatgtgattttgcatatcaagtgcacaaaaattaagcttatggtaaaaaaagtaccattaattagtgactctactgtaattgaatcagtggtcattgtaatgtaccttaaagtcactatggagttttaagacattaatttacaacaagaagagaaaaggactaggaacataaacatgtctgcacatagatggggaggggaggctaaattgagtgaatccctccaattttttcactttctcctcactctgaccttactccaacatggcctcaggctctagatttctaccagatcacattacagaggcatgtgatgagaaggaaccacttgagtcttttttttttttccagaaccaagccaagtaattcagtcatgcaaaagtttacgcaattgacaatattcactcatgtccccctgtttacaattttaaggtgtgtaaaggccagtcacaagcaaggacggtcagcattgctttggtgtagatggaacacacggagacgatggaactgcagggcgctcacagacagatagttgaccaagagtgaagggcagtagctaaaactgagtgcctataaggtcaaggaatgtgacataaaagagatctgtggatgtggcacaaccagtcaaggccaattttggggaagatgtaaattttaaatgaggtttcataggaagattggcgatctaagtagggaaaaatgttttcctaaagcgaataagcatggcgtgacaactatatgttgtgttataagtttttctattcacgaacttttcttttcttttcttttttattcttctgttatacagaagttcccaacctccaagccatgaactagaactagtctgtggcttgtggggaactgggctgcacagcaggcagcgagcaggtgagtgagcagagattatggcctgagctctgcctcctgtcagatcagtggcagcatgagattctcataggagcccaaatcgtattgtgagctacgcatgcgagggatctaggttgcgtgctacttttgagaatctaactaatgcctgatgacctgaagtggaacaatttcatcctaaaactgccttcccacaactggcccatggaaaaattatcttccacaaaactggtccctgatgccaaaaagattggggactgctgctgtcatataaggataattatcctcattttacagaggaggaaattgaaagtcagatgtacagtgactaaaatagctaaaagtgatgaaaattagagctgaggtgttggtccttacagaccttctacttctgttgcaccccagggctctgtcctggtaacatacaaacagaggcagtgccaacactggagggtggaaggctcaggccttcattctgaccccaaggcacccagtaccttccatagtgcttgctgtcatccctactactattgtctgctcactacttctctactggtcacagagaaagccataaaaagatgttttcatactcatgagttcccccatgcaggcactgatagaacttgataagttgattcatgctctgtagttctcttcacagcaagcagctcgtctccctctcagctttcaccttcaacgccctgcacagcaagcctgtggcagctctgctcctcagctgtcagacaaaaggggagaacaaagcaagactgtgatgcaatactcatgttaggtaaatctttccccagctagtactttctgtcctgggattattttgtgaacacagatttcgttagagagcaattgatctgaacatctgggggctcattagctccttctaattgctataatgtggttccattctgatttcatgcaaggggtgcagtcttcatgcacaaactattgattaattacacatttaaggcatttgagaatatcagctgagtgcatttgtggtttcctaggatttctcctttattttccctgtctgaacttttccttgttccttcgcctcccccttacctcttgccatgccaatcagtctctaaagcattcactttataaacagaaagtcaaaatggtgctttactatttatctggtaactcatattggaatttggaagagtggctgatgtgaacaatggctcataagaacattaatttttcttctgtactgaatagtctcattgaaacagatttggatatgaggatgatgcttacataataaatacccaagctggttgggttagcagattgtttacatgtgggcacatgtgtgtggcttgttgctgcatggttgcccattccaccgggagaagctctgttgttatgtgtgttatgaaatttcaaataagggaagaacaacagctgtaatgggcccaatccaatgatggcaaaaggtgaataaaattactccctctgggaagtaaaatgctcatttagtggagggaaattatcatttccaagtagaacatttggcttcctgagagtgaaagtgtcggcacagcttgataataacacctcaggctgtaatagtaccctttcccctctgagagctaggctttttccctctaaatttatctctacaacgtctttgcaaagtgagtaggcacagttgttattggccatattttatagatagagaaactgagagtctaaaaaactcagtgatttgtccttggaagcccagaaatcaatctagataagggtttctcagccttggtgccactgatatttttgaaccggtaattcttggctgtggtggttgtcctgtgcactgcagaatattagcagcatccactagatgccagtaatgcccccagttgtgactaccaaagatgtctccagacactgtcagatgtcccttgggaggcaaaatcacccacagttcagaaacagtgatctagattggtgggcccggacggtcttgtagcctttaggaaacctgaagcaaaatttggaaaaataaaaatttgcccttgacatccatagtttctcccatctgtaataacagtacatatgtaggattcattattatgaagtctttacacttgtcctgcattattcatggctttacatcctgcattttcagttaccgttggtcaaccaaagtctgaaaataataaatggaaaattctagaaataaaaattcataagatttaaattgcctgtcatcatgagtagtgtgatgaattctcaagtgtcctgcttcatctctcctgggatgtgaattcttccttgtccaggatatccacactgtctaggctccccgtttgttcatcacttaatcattgtgttcgtcatcagatcaactgtaatggtattgcagtgctggtgccaagtaaccctgattttacttaataatggccccaaagctcaagatcagtgatgcttacagttcagatatgccaaggagaagctctaaagtgcttcctttaagtgaaaaattgaaagttcttgatttaataagggaaggaaaacaatcatatattgagattactaagatctatggtaagaatgaatcttctctctatgaaattgtgagaaaaaaacaaaaggatgtgtatatagtatctataaagttcagtactatcctcagtttcaggcatccactggggttcttggaacatatcccatttggataaggagagactactgaatataccttaacttcaattctattttaatcacatttttcacataggaaaacagaaccacaaaaaggttagctcacttgttcaaatttatacagctaggaatcagggttggcttcatgagcattttgacctaagcagctacacaggatcccatgtttagaagggtgtcatacttggtttaatgatcttgctgtccttatattgaaactattaattatttttgaacaagagtttcacattttcattttgttttgagctccacaaatatgtagctagtcctgctaggaggcaaaatagccaggattccagtccagggagtttaaagacaatatgtttaaccttttaaccatacagcccctcattctttcacatgtttgttcatccatttacttttcagtaaattgtgctgtgagttcattataaaccaggcactagacttggcagtgatggaacaatagaggcaaaacagatgctgtcccttctcttatgaagctagcagcctcaggaaggatgcaggccaacaaacaggtatttgcaattcaacatggtatgtgttatgataggaaaggtctggttgctatgggagcatacatataggagggcacttaacacagtatggggggattaggatggtgtacaagctgaggcataagggctgaataagagttacataatcaaaactggagaatgagtatgatctaagctaaaggaaatagaagtataaatgcttagaactgaggaggagtgtgacacaattggggaattaaaaatagcttagtgtgaatggaatattgaattagtcagctttcactgttgtggttcagtaacagccccaccgtgtcagtagattattacaataaaggcccacatctcactcttgttgctggtgatgtgctattgggttgtgctgcttctccccaagtctccatttcaggactaagccaggaagagcagttcctaaatgaaaatgccattcttgtgatagaagaaaaagaaagaagtagctgaaccacacacaatagctgaagctctttggctcatattccattggttaatcaagcatgtggccatggtcatcatgggtagagcagggaagtatcctgctctcctagggggcactacaagtcacatagcaatgggcagatatgttatagttctcttaaagggagagcagagactaactaggaacagtaatatattctaccaggtaagaatgagaggaggtgagtggtatgagaaggtttttggaaataattaggaactaggttatgtgttttatagaatatattaaagcctttaggtgcaattcattactcctttccattgtgtactcattatttggtcctacgcgtcctactcaaaatctgcttttggaaaacaataataataacaacagtgacaagcaaaacaaaaaccaagaaagataatgtcattacacactaaagtacaaattatcctttatacagtacttatatctttacagaaacaaaggaaataatcagttgtagagtggcagtcactaatgtactagtgaagggtgaattttgattccatctatggaaaaagatatttcttggggttttggaaatcataccttgctgacttttaagtattgccctactattaagaccaatccataaatatttactgattgcattctacactttaagaactgtgattgctgaattctcatcttcaaaattcagtcaagatgaatgaaaggcagcctgatagagtgaaaaaagcatgaatcctgtcctccggcagacctgcatttgaccaaattaatttagttaatacctgtatgaatttgggcaagttatctaacatctttcaccttggtcttctcatttgtaaaatgggattataataccttcgtcagaaccacagatccaacaagaacagcaacttttattggatactgcttaaattccaggcacaggcacagggctaagaacttttcattatgactcttaaactttgtcaaacaatgaagtgaagactataattttacagaggaggtaactgggaattaaggtgttaagcaacttgcccaaggtcagacatttagcaaatcatggaacctgaaagtaagcccagccacacaatgaccgaagttgaactctttattactgggtaataagaacagtaatgaaaacaagaataataacaaaccacacagtattccaaactctttaaaatattagattatttaattctcagtgataccctttcagaacatgcaagtgatatagaatctcaggttcaacactctgtatatatataaccatatatgcatatatctattaatctatgtatatctctatattaattaagcattttttctgttcttggtctgttacaataagtgaggtaaagtaggctgttcaatttattatacattaccatattcaatggaaaatgctaacctccaagttagagaaaacttgatagaaaacttgttaacattgtttataagatgcttaaataagctttgagtgaggatgtaagaccctcacactcaaatagaaggtgaaaactataccaaatggactttttcatgtattttgaattcagaggcctctttttactccctgtggattctgattatatttgagatataatcattaggttcaatgtcccataaatatgtgaattattaatataaattattttcccaatatttttctggctttctttttgtgtttttctttccagggcccaagttcccaaatatgtttccttttgcccttttattagattatcatcaatagtaggtagtcattggctttatttcttttcattcccaggctcatccaacaaactgaggaatgtcctatattttgcctctcattgtctgagatgatctttgtgtggtttcttatttatgtatatttttttccctccaaaatcatatgaaaagaaattgcaagttgaaaacattacttctggaaatgctattcatccttcagcacaaaatttgactgtgattttctaaataaaacaaggctttttttaaaattatactttaagttttagggtacatgtgcacaatgtgcaggtttgttacatatgtatacatgtgccatgttggtgtgctgcacccattaactcgtcatttagcattaggtatatctccaaatgctatccctccccccttcccccaccccacaacagtccccagagtgtgatgttccctttcctgtgtccatgtgttctcgttgttcaattcccacct

SEQ ID NO: 23 - DNA, 18379 bp, Homo sapiens
aaacatacgtgtgcatgtgtctttatggcagcatgatttataatcctttggggatatactcagtaatgggatggctgggtcaaatggtatttctagttctagatccctgaggaatcaccacactgacttccacaatggttgaactagtttacagacacacaaacagtgtaaaagtgtccctatttctccacatcctctccggcacctgttgtttcctgactttttaatgatcgccattctaactggtgtgagatggtatctcattgtggttttgatttgcatttctttgatggccagtgatgatgagtattttttaatgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaagtttctcccattttgcaggttgcctgttcactctgatggtagtttttttgctgtgcagaagctctttagtttaattagattccatttgtcaattttgtcttttgttgccattgcttttggtgttttagacatgaagtccttgcccatgcctatgacctgaatggtattgcctaggttttcttctagggtttttatggttttaggtctaacatgtaagtctttaatccatctcgaattaatttttgtaaaagttgtaaggaagggatccagtttcagctttctacatatggctagccagttttcccagcaccatttatgaaatagggaatcctttccccattgcttgtttttctcaggtttgtcgaagatcagatagttgtagatatgcggcattatttctgagggctctgttctgttccattggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaggatccaaaattgacactctaatgtcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaagatcaacaaagttgatagactgctagcaagactaataaagaagaaaagagaagaatcaaatagatgcaataaaaaataataaaggggctatcaccaccgatcccacagaaatacaaactaccatcagagaatactacaaacacctctatgcaaataaactagaaaatctagaagaaatggataaattccttgacacatacaccctcccaagactaaaccaggaagaagttgaatctctgaatagaccaataacaggctctgaaattgtggcaataatcgatagcttaccaaccaaaaagagtccaggaccagatggactcacagccgaattctaccagaggtacaaggaggagctggtaccattccttctgaaattattccaatcaatagaaaaagagggaatcctccctaactcattttatgaggccagcatcatcctgataccaaagcctggcagagacaaccaaaaaagagaattttagaccaatatccttgatgaacattcatgcaaaaatcctcaataaaatactggcaaatcaaatccagcagcagatcaaaaagtttatccaccatgatcaagtgggcttcatccctgggttgcaaggctggttcaatatacacaaatcaataattgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctgtgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattctccctgtttgcagatgacaagattgtatatctacaaaaccccgttgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagagcatacaaacaaatggaagaacattccatgctcatgggttagaagaatcaatattgtgaaaatggccatactgcccaaggtaatttatagattcaatatcatccccatcaagctaccaatgactttcttcacagagttggaaaaaactactttaaagttcatatggaaccaaaaaagagcccgcatctccaagtcaatcctaagccaaaagaacaaagccggaggcatcacactacctgacttcaaactatactacaaggctacagtaaccaaaacagcatggtactggtaccaaaacagagatatagatcaaacaaggctttttgcgccttcagcaccttggttcttttaagcttcctttataatatcttaagaaaatctgagtccaggagcagtggcttatgcttgtaatcccagcactttgggaggccaaagtgggtggatcacctgaggttgggagttcaagaccagcctgaccaacatggagaaaccctgtctctacgaaaaatgcaaaattagctgggtgtggtggcacatgccagtaatcctagctacttgggaggctgaggcaagagaatcgcttgaacctgggaggtggagtttgcagtgagtggatatcatgccattgcattccagcctgggcaacaagagcaaaactccatctcagaaaaaaaaaaaaaaaagaaagaaaatctgaggttgaataactaacaattttaatatttagttaagaggccaaatgaagtatttgtcctaccctcaagcagccctgctgtccttaagaaacaacattatattttccaacgcacaacaataaaatgcacttaaatggtatttttttaatccatgttaataaaaggattcaccacaactgattaggcttaatgtgcatacaaatcacaggacagacaatatttcagttccaaatcttaaaagataaaattaataatgatataacttattttcattcaaaactaaaatgcctttcagatggtccaaaagtgtttcatcaccatatggcagtatatctcaaagagtgatttgctcattgcctgtgcaaggtccatttgagggctggaaaatccaggttctcaggctctatcccatcttactgaatcagtgttggggatttgggctttgtaatttgcccctttaacaaactccttagaggactcttgtgcatactgatatttcagaagcagtcttatggagaacaaaataaaagaggagataaaatatcttaagttgtcaacagatagagatttaacaactatatgctacttgcactgtatcttcgggtttaatttagatttagcaactactatgccacttgcatgttaggatttttagtttagtttagtggcaagtgattaataaggccaaacaacttcatgatcttctgttattgacctaatttcacaatttaacacttagaattggaatattagctactgtgcaaaattcagccataaatatttaaggatatttacaacttggtttcatgctccattaaaatatatttactatttgttgtttagaattaaaaaggaaatctgaggtctaaatgttcaatgtttagattaggctagtctagaaaattcatcaaaccaattccatggggtagtgggtatggtcatcttacaaaattgaatgtatactatttgtgttatgagaggttgaatctcaaagtgtggtctgtggaccaacagcatcgatattacctaggagcttgttagaaatgcagaatctcaggtcccacttttaatttgctgagttagaatctacattttaacaagatgcccaggtgatttacatgcacattaagccaaagaagcagtgctctaagaaactgcttgttcctagaaagtattgcttaaatataggctcagaactgttgtttacataggacttgtggatttctcttgtggttaaaaaatttaaaactacagttaagagaaacgagtggtccttgcagcaagctaacaaggagcccttgaatattaagatggttgatacttaaggactgcagcaattgctgtctaaaccagaaaagtatctgagcacaattgacaatggttccatagactcctggggatagtcacttgaatgattaattattaatttttaaaaagaacttttttttctgctgtgcactatacaaaagataatgtatattaaatataaaagaatcataaatgataaaagcatttgtatgcttagaaacttggtaaaggggatagagtaaatgtataatggaatcactgcatttatatcaataaatgagagctaaaatatttttataacttttttgtcagtacaataaagaggacttttggagacagatggtaaatcaatattgttttaatatataatatataatgagaaggagcaatatgatctagaatatttttgtatcaccaaaagcaaatatcaccattaacattcagatctgagaagaaatcaagtgtcaaagagtccccaaaggaaagggagacttcaaattattcaaagatgaactggaaaaatcagttactttgtataactgggggtatactaaatgtgttctggtatggaaattgtattcaatttctaaacatctcaggttgcatgaactgggcaaggctataattagtgactgtgcggccatataacctggattagactttgatggaaacatcacttcattgtgcatttcttgtgccagaaattcctatatgaagaatgacatatgagttttgtaagtcaggctcataatcactaagcccaaataacttcatggtcatctattctcgaaccaattttaagacttaacaagtagggttggaatattggctcctgtggagaattcagtgatatatatttaaggatatttataatatttataatttgacttcataggtaattttatctttagtgaatcccttttcttaagggtagactactttaacagaagctattaagatgagaaatattttaaaacagtgaaaagtccctagcctggtcattaatagataaaatgtaaattaaaaacaaaagtaaacacttagaatccatttacctaactatcgtcactcttttgggggaaggatagaccttggaagaacctatataatgaccttacaaagtaactattcatcaaatagtggtggactatagtcctacaaatactggttcaatatcttcttagtcatataggcatttagcactgcactacaattattttgacactatagatgcttgttcacattctgtgatttgatcacagcaggaaggacaactttaaatatagaagagagaagaaaaagataatctccctcctctctctgctcatttcacaccttcttgaatgaacaaagttagtcttttcagaatatatgtttaatgatgtaataagtaatgtgctaccaaaatggcaaaatagatggactagggagagcatcagtcatccctgggagatgctttagacccagaaaatgacttcctatgatctcacctgtgatgagatgagaccttttcttatctcatgaaataatctctctttttcctctcttgtattttttctttctgtccaatgaggaaaacaaaaacaaagaaaaaaatgaaaaaaagaaaagaaagcaaaacaacacaaaactaccaaaccaacaactggaaaacccaaagcttgtaaactgtttacaggaaaccaaatagtatttcctgggacatgagatgaatatgagatggcgttttttattgtcactttgggtacagaggccgaaggtcattatctaacaggcatacaaatggaatcaatctctccctcaaagagcctgtcagatgcacctgagccttcccgggtgtttgcagagtggttcatggtcaaaggcaagaatggatattggcacttcaggggaaactatattttcctgtcaatagacagaagattgcagtgtcctagacaggtaatcagttatcaaggaccacaatcagctcacgtttaaacattaaacaggtggggcaggagacaagcaaaatttatcatgtttactagttttgccaacaaccaaagaactgctttattctttttaatcagttctaatctgtgcttctttatatctattttgaaagacattcaataattttttccccttggcaaacgcttggtggattcatagagtcaaaagtctatatttctataagtatatattttttaaaatctcccatttttctcttggctttggttagctatatgtgtgtacaaatcagtccctatgacacccagtttctatgccagtttggtgaatggtgtggggaaagaaattgaaaaaggctaaagcaaaccttctcctaagattaaacagtatgtggtttgttaagtttttttttttttcctattccaccattaaaagtaaagaagaatggcttttctttttttttcctgattagaaggcttcactggatttgtggcaaataaattgacaagtgagggcactgatgacaagagagtgataattgatggtggcaggtgggggcctggtgtactggcatgtcctgtggagggtgagccaaggacatctatcaatcaaattggtgacagcagccagggagacttaattggagattcattgaacctttaatgttgtgacagagaaaaataaggatgcttaaaaggctcctgggctatttcttttccttcattccaacaattctcatagaaagaatggaaagtggacattgctccagggttgaacattcattgtttccatcaaagttaatcacatttttttttttaggaagcaaagtagtgaaagtatttaccattagtccaatgtggaatgaaatctatacctggagctttagggattcgactgttctgtggtgttagcataatcagggatgtttagcaagtgttcagacaccatgtgcttaacactgagtgtcaactagggtgcaaatattgtctgctggagtgtggattccaggcatcataaggaaaaaagtccttttcctaatttaataatcttctcttcattcttctaaaaagttctctatacaatccagatgtaaatatttttcttttttttgtgtgttgttgttgccagaggttcaacataattttatttcttatttggaaaatgaaagaattcagtagagctattttccctttaggcacagtacaggaggtttttcttaaaattagtagtgcaggaaaaatcccaacagttcaagacactgtatgtggatataatgtgtgaaaagataagtaagatggtctctgtcatccaagattatatatttttatatttatgagtttatacatttatttattcattctaaatcataagtttgggcacttactatgcatagtgatttgttaggccaagtctaagatcaataggacctcgttatttcttggaaggaatttactgtttagtgagggaagacagatatatgtactgagacattaaatattgcaatgttctaggtaagaattgagagttgtgatatcacagtctaggatggtagaggctgcagatatcaggccacttaagtgacaatttttgtcttttgaaaattgctagaatactgcttcaaaaagattggaaagaaagtaaagatcctagacttgctatggcagagattttatacttaatggcatccccatttagccaaatttttaagtcatagacagcagagagggattacctacctcttccaccactttctcacagtttgaaattcagcattttgccataacttttttctacaaggcactgaatacaaacatttccctttaattactaaatggaggaatagtaatttaaattagtaatttttaaattttactagtagtaaataaattttagtaactataacttttagtaatagtaattaaatagtaattttaactttttcatcataattttaaaagtttccagaatgtcagcatgttgttccacccagtcacaatttgcttttccctgtgccaaggccccagttcagcatttattctccgtattatgcacttcaacaagggttgactgcttgaaagtcctcctgttggctgaactgtaaataggctacagattactcaattgtcttcctctagaatcttgtgtctctttccctgcatatttacagatgccttgaaaaaactcacagaggcaaaaatcacggtaatcaggaaactgtaacctggcaaaaaatctgtagagcctctcctcattattgagaacagctgccactagccaagtgcatactatacttttcaggaaaaaaaaaagttcatttaaaagtaatttgaggcaggtggtatcatagaagaaaataattttatttatttatttatttaagacagagtctctcactttcacccaagctgaagtgaagtggcatgatttcagctcactgcgacctccgcttccccgggttcaagcaattctcctgcctcagcctccgaagtagttgggattacaggtgcctgccaccacgcctggctaatttttgtgtttttagtagagactgggttttgccatgttggccaggctggtatcaaactcctgacctcaggtgatccacctgccttggcctcccaaagtgctaggattataggagtgagccaccacacccggccaagaaaagcattttaattagaatacttggaagatacattttgaaaaggaagattctagattaaaattttgtgctatatttcattgtgcttttttcattgaaaatgttgatataggaagaattctgtcatctgtatcccgttttttcaggctcatcaagtcttataattaactttcctaggtcctagaaatatattattcctaggttagaatattttctgtagaatacaaattatttataaaccatcagcatgggcaatgagccagctcaagattttgttagaaacaaaaacatgaaagtcaaagttagaatgattcttttaaagtattttggtcaaatcatcaatgtggtaatcaaatctcctttagaacattttctccatgtggtcttccattccaagtttgtacatgtgcagcaaggcagactctacctgccatctatctctgctgtatttgtattctatcttttaatgactgtctgttaaatactttttgttaatgttggtaagaaatcaatctctttgtagcatgtagtctctggactggattcagcatttgtctttggatatttagattaaccagaaaaactccacttgaaaattccccaactgtttgaagatagttattgtatcccttccaaaactctaatttttttaaaaaaattaaacattcttcttccccttagccatcttacccatgttatggttttaagtcccttcattatcaaaagtgctttgctctgtgctgatgtaattatgatccaagtgtctctaggcacttcttagaacatcttgtcaagacttgaacacgacaccaggaaaggtttgaccaggtttagagcagggaaactttttcttcccttacaagttgcatctcttaaattttttttttcttgctgtattcaggcctttgatggttaattttatgtgtcaacttcactgggtcacagtgcccagatatgtggttaaacattgtggacattcaatgaagatgtttttagatgagattaacatttagacttaacattagattttgagtaaaatagattaccctctattagtggatgggcttcatctaatcagttgaaggcctcaatagaacagacggatttcccgagtaagaagtaattcagcaggcagatgttcttcagagttgaactgcaacatcaactttttcctgtctccaccctgccggactaccctgcagattttggatttaccaagcctctataattgtgtgagccaattccttaaaagaaacatggatgtgtataatacacacatacacacacacaataggatatgtgtgtgtgtattatgtattttatatatatatataatacataatatgtatgtaatacacatacacatacagatatcctgtttgttctgtttctctggagaatcttgatacaaattcaaaatgacggcctgtatattttgtcatcttgattgtgtcatctaatatatttcttttcatcatcatctttgtgtcatctacaaatttgacaacaacaagagctgggtgtattctttttagtctaagaacaatggattttcttcattttaatgattataaaattacctttgatggaaatggttcttcatagagaagcttctaccaactattgctgattatgcttagtgaaagattgagaacattaacactgcatctcagctccccctggtggacacaaccctcacagacattcttcaatagaattgccgagtagagtaatagatgttattgatagagtgtaaaggcacatggcttaccgtaaccctccttttaaaaaggtacttggataaccataaattatgacacccctcttgagattttaactatttgtgagaccctgaggctctctcctcaccataatgacttaaggttgtcacagtgatgagtaagttgttttatgaatattcaaaatatttagaaaacaaatcatacagacctaatataaaaattatgataacagattgtctaacctagaactataaaacaccatttgctaacacaatctttattaaataagcagtaataagacatcttacattttatttttctaattctattagaattatcttaatgtaatacttgctatctaccattaagtttttttaattataaaagagtatagcttaaactaaagaaaaaaatcttatatatattaagaattacaaataaaagctatgtattgagggcctgttgtattatatatactccataaggcagtttacataggttaatatgcatatattcgcaacaactctataagctaagttgttttaccttcattctgtatttcaagtttggcaaactatggcttgtaggccaatatagcccttgtatggaacgtattttacacccagtgagtttaaaatggttttcaaatttttaaatggttgggaaaaatcaaaagaagaataacatttaatgacatgtgaaatcttataaaattgaaatttctgtaaataaagtcttattggcacatagctatattcattcatttccatattatccatggctgcttcaatgctataacgacagaattgagtagttacagcagagacactgtgctatggaaagtccaaaatatttattgtactatctggccccttacagaaatcatttactgattctgctgtatctgatgaaagtaaggcttcacatttttaagtgatttcttcaagagacctgaggataatcaaagtaataatttctttgttattagtttcttttctatcccaagtaattgtgtagtgaattctgtactaaatattaatatatgcatttagagaaacaaatttgaaacaggataaaaagtgtttttaaacaaatttaagtcaatatttacaaggtttttttgtgtgtgtacacaagaagtatatattggtagaaagacaagtgactggagtgtacaaataaaatggagatggaatggacagttataaactcttaaaattcataaccaggcactaagatttcatggttgttctatacagtaggtaagctttttgtcccatcctggatttatgtttttccatttctaagcatcagtgatatggttccataatgtggtattgacaatgacgtttaagaggaaacatagagatgcatagacatgaatggctcctgtgtttatgaagtggtatctggaattaaataggaagatgcatgtgatatgcttggcagaaaccctagtaaaatgtcaataaacaataatcatcatgatagttgttagaaagttatggttggcatatctataatttattggagatatccctggaatctggacactggggcagtctttcagatcttcgatatgtcttatagcatggtttctagtgctagatgatgaggattcaagatgatttaaagacaggagtaattattttactggaaaatactggttaaatagattttttccctttagaaaggctactgaacaactagaaggtggacataaatatgttgtttccttttacatttgctctctggagccaggaagggttaagaaagagatacttctttcctcttagtcgggattcatacagaaatcaagagtgggaaggggccctcattacatcagacacagttactttaaggatgaggaatctgagacccagataaataaaataatctgcctaaagctgacccagagttagtacggggctctggacgatttcattatgtcatgataccattctcttccaaattctaagattggaaaatttacctcatatgaagagtgaatttaatttatctttattctagtttcccttcaaaggcatgtcttaatatacatggataagtcatttcaaaacctctaagcctaaggtaatttgcactgcaaattatttcacaccataatatctatctcagagcttttcctgagatgtaaagtccttgatgataaaaccgactccgtagtaatagtagaggacttatttgtattgagaatgcagacttgagtgcaaaggggccagacaagtaaagactgtatgtaaattagtaaaggagtaggagatgaaagacaatagggagtagaggagaatgtgctcaactagaaaagaaagagctaaaatatggacagctgttactcagccccatctgatggttaccatgcatgcatgattttgaatttgctaaatcctctcaattcaaagaagctgaaaatctagacttttaaatgtggagacgttctgatttccttattactgcatgggtcaaacaaaacacatctgcatctctactaaaaataagaataaaaaaagaaattagctgggcttggtgcggggcgcctgtaatcccagctacttgggaggctgaggcaggagaatcccttgaatcctggaggcaaggtctcagtgagccgagatcgcactactgcactccagcctgggcgacagagacgaaaaaaaaaaaatctgtggactggtttagacctttaggaagcatcatcagcaatgaaaaatcatgatgttttcattaaaaataagagttttacatgcaatttgggttgtagggtttacagtttaatattttatgattctttttcctctttttttaatcccaggagcaagagcatgccatgaatctagcctgtagattcagcgtggctttctggctcaaacttagactgcatcaaacagctttgcttttgttttctgcttgaaaaaactgacacttgttatggttacactcactgtgtgagccatcccctgttgacttctggacaatcactataaatctctattatttcgctgttattgtcttgttatactagcactgttgaggcatcttctcaagggaagtgagcccaggtgtgcacatacagaacaagaaatactctcccttaaacacataaatagctattttatttggcacaacacacacaaatgttagtgtagccaaaggaatcttgaacagttatttgcattgcaaatacttcaaaaaactggagcaaaggtatcagagctcaatctgctagccatttgagtttcattagttcagagaacaatccatcttttatttttttccagtaataagaattgaaatgaaattcagtgccttacaatcaggctccaaggcataagaatttctcataaaaaagaatatattcctgtttccccatgaaattcagttatataaacctctttttatgggtactctttctttatggccctgttcagagaaaatgtgcagggttaagctctcttgtgctacacattcattgttttgatatacaatccgatggaagactgcaacagtgctttctgagatatctgggcatgaaggtttgaagattcccaaggcaaaaagttatgtcaatttccttagtcgcacatgtgattaaggggtacctttggttctggtacttgccaattcatgacgtggcaaaaaattacataaagaacaattggcagataggaggttgtgttttagaggcctgagtagaattggggaaggtttaataaaagctggaagctcagtttcatataattcacaaaaagctaaatctatatttataagagttaagtaagaaagaaagagatttggggggcaattaattttctatgtaagtatgtatttatttggttgatgggatccttggtgaatttctaatttttattattttataaatttagtaaaacatgaaaaaggaagcaaaacttacctatatgcataaagctttggggaaaaagctataacagactgaaacaatcactctccactttacagtactatcttcagactcatatgaatatgaataaaatatctgaacataaaaatatttttattttatgaaaaatgagatcatactgtttattcctgttttaaatttaaaaatacatatttaataacatttaaaaaataaagtaagaaattgtgacccaggcggtttcttgacatatactgatgtgcatcctccccaaaccccaagttaaaagaaatgataaaagtcagtaatcctctaattacgaatcctctgattttgtataagcttccaggacaaagaaactttgtgcccttttccataaggaacaaagagggccctgtgggaacattctgcattcacgtaggtttggagaggagaacggaaagctacagaagcagacacattagcaagcatattggtaggatgattgtagttgtgagaattctgaaacaaatgtaaaaagggtgatgttatgaagactgaagggaggctattgttagattgcttggaaaggaaaggcccggtgaaaaaaggtacactcatgctgacacctgattgacaagaagaagccagacacgaggattgcagatccttctatgcaaagggtaaaggaaatgcaaatcctgatatgaagtaaatatcctagatatgtattagtaaatagcatccaaaggtatattattagaatcattgtatgcagagttattccagcaatgcaaagatttcattcggaaaagttttaatgtaattaattacaatcataattacataaaaacctccagcaggaaaacaatttgatgataaacaaaagagtgactacttaaatgacaggtgacttttaataactgcagtggaagtcaggtgatagtagaatgatatagccaaaatatgaaagaaaatatctattaacctataattctatactgagcaaaattttatttttcagaaacagaaagaaatgcttttttggggtaaacaagaactgagattttactgacaatagaatttaactaaaggaatgtctaaaacttctcctttaagagagaaaaggatcatagtggaaaagtcagaagtagtaccatatgaagaacttatggtaagcaaaacaatggcaagcctgtgggaaaaatctaaaccatcactgactgtaaaacagtaactatcttgtctaattgggaaaggaaaaaaaaaacttaagatagaaataaaatgtgaaaggatgcctgtaatcccagcactttgggaggccgaggtgggcggatcgcctgaggtcaggagttcgagaccagcctgaccaacatggagaaaccccgcctctactgaaaataaaaaattagacggcttggtggcacacgcctgtaatcccagctactcgagaggatgaggcaggagaatcacttgaacccatgagacggaggttgtagtgagcccaggtcgcaccactacactccaacctgggtgacagagtgagattctgtctcaaaaaagaaaaaaaaaagtgaaaagaaaataaaatctcgagaccccaaactcactatgccaaagggaaaacttaagcttggaagctgagacacacacacacacgtgcacacacaccccaaaaaacccaactcaacccaaaccaaaccaaaacacaagaaaacaaaccaaaaactgacttcctcttgtttccaaacagctgtaatttcacagctcactttatcttatgtaaaatgtagatttactgagtgctagaggaatgcataattgaccctccctttttgcatgtaaaatgtggactcagtgagcactaatcaaagcctcacaagagtgtaaccacttgcctcgttgcctaacctcctcttttatttttctttcctcctctccctcctgcttgcttggtccccttcaaatattgatgtcctcaaaactgtctttggaaagaagcataggccatggattctattataacttgtgattctgtttcttagacacatccttaactttggcaaaataaacctctattccattgagatgtgtctcagacactttgtggtttataaaaatcttccccaataatattatataagtgaggaaggagtgtgattattggaattaaccattgtaaggtcattgtatttttcagagggaaaataaagatattcagcttagaactgatgaggttaaataagcatgctaaaatttctggaaaaacaatgaaatgaaaaaagttagacgaggtacttaaaaatgagtagagggaaaacatcaaatggggattggggagaccacgtcaattcaaaagaagaaaaaaagagaaaaaataagcacactaggaaagagggggaggacaaataagtaatacaaagatggtagaaatgagtccaaatttctaatcaagatgaatagagtaaaccatttacttaaagacagaggatcaaattgaattaaaaagcaaaatacaattatatttgtcttatagaacttaactgtaaaaaataatactttgaaaatatatcagagcatttttttggaaccctgagatgcctcctgaagccacgaggagttaatggcaaccctttgtcttacaaggccttacgtaatttaattcttcaactttgaatttcttgctcactctgctcaaccacattaacctctttgctgtttctggagctcatcagacacatgccagcctaaacgtttgttctagtttttccctctgcttggaatatcctaaacccaggtatctacttagctaactctctcatctttggttccctactcaaattttacattctcagtgaggcccacctagaccaccttacttattcctgcaacttgctcacttctcttcactttctactttctttctttgctctggtaattattggcacttatcaacttctaacctgccatatcatttaacttttaaaactgattgtttattgtttgtttttctcccttagaatataaactcaaggaggaaaggaatctttttctatcttattcacagattctggaatagtgcctggcacatagtaggcacttgataaatattcactgaaggaataaatgagtgctatttctacccctaatttacagcacaacatctggcaacattttattaagtaaaataaccaataagtaaaaagcaaatataaaatttgatttctgtattttctcttcgtattctggaaaatgctttggagatgagggtagtaggaagaaatgggaaaaaggcagagggagatgagcctcctccctttccactggatgagatggttgaactgcaggtcccttgatgtttccacactagcagagaattctctcatttctcttctcagggatgatccttgaagcaggatctacaatagacagcatcaaaatcaacaggcatatgataactgacagtttggaaaactatgacctaattgatgatacaagacccattagtttgtggggcctaagaggaaatttcaacaggaaagattagtcttgcagcctgacttgtggatgcagcagttgcctcatgctatggattgcattgtatcaacccctacccctcaaattg

SEQ ID NO: 24 - DNA, 3454 bp, Homo sapiens
agtatgtgcatttgtaccttgctttgttttcctcaactttgtgcttgtttctgtaattccctcattcattcctacctctgcatgcttgaaagttctttgtggataaggacttggtccgaattatatttcctttcccatcccatgcacgtggtcctctctcaggaaatagtgcaaatgagcaactattgcaccaagttagccattctctaaacataggtactacctatgcactttacaattcttgcttctaatttatttctgggttgcatggaccttacaaaaaggagtagcctttttgaaaagattggtttgaaaaaaaacaatttcaagcatcgtttgaaaaggctgcgggaccaaaaagccagcacagctcaagtcattttaaacatgcaatgattctcactctgaatactcagagtggagactcaaagtgtggctctttgcaagttaatgtcactctggccattccttacactttgatcattcaaacagaagtcacatgtggtttcgtctcagctctaagaaggccaaacatgaatttctcaagcctgtccaaacaatctctcagaaaaaaagatagaggttggatcatttgttcatacagtttgattagctaacacacattttatagtacttgaagggttgttgaaaaggagttcctgtcttatcactagaaggtgaattcttgaacctgtaaaataaactagttagtttgcatgtctttatattccttccatgcatttagatatacctatttccagacaggttttcagaatgcatttgggaagcctgtgattaaaggatattttctggtatggtatgaaggctgagtctcttgacaataactttcagaaaaagaataaaatctattttacatcagctgaatgtctctaattgggtcttgaagaccaaacagttcccttcaatgcagctggggctttgggtagccccaaaccaattaactcaaattatataattttcttcccatccctacccccaaagcttgacttgcttatttagtaaagaggaggattagcgcaagcactaaggagctgttctctggctgcctggcacaatatgtgaacttacttctgggccagccagaagcatcctggctgggaagaaaggaaaaggggaagctgaagtgaagccgtctccttggtgtgactctcctctttcttgggatacaatggaactcagcagaaatatattactggattaccaggcagcagaaagcatgctggcctttaaatgggaacaagcaatctttagccctcctaaacctctaaaaatgtgcaggagctaattaaggcaacaacatcatgaggtgatcagagaagagcagagaaatgtgaacggttagggggaatctgaacaggtgtgtatgtgcggtgtgtctaaaggagcaaaaagctttactatgaatagatttcatctttcttctgtttccaaatgatttgttaagcctggggtgagcattgaacaaataacaaaattatgtaacaattccaaatgtatattttccaaattaaaaaaaagcaataattttaaaaggcagaatgacaccctgcattgcaactgtatcagaaatatgcttagtaacctttattacaaggcagcttaattttttttctattttatatagagtactgtcttttgtgatccttgtaacaagatactaaatacctgatttgataattgtgacatataggtgaatttaaaatagtttagttctaataagaaagaataattaatgataccttcaggtgggcaggttttttcaggggagcattttttcatatttattggacagtgaaatctcagcttctaagtgctgaccttttatgtgccaacaagagaaagcaaatagtagacatgcctcaatgtctcccttcttttctaagcttataaaatatggtacttaacttgccgtggtattttctcacacattcctttctgaggggaccctgccctggataccagtagaatggttttatacaacaggcttccctgatgttctaggtcctgggagttatcttctaagcttgagttttttgctcatatgtctgtcaaaaaggaaaatccagtgaaattaaagttcgtcaggaagctacaagtctgttttcttacagctcccatgggcaaagtagcattatatcttctgttgatgtcaccatttctctgggagattctagaaatttgttcattggtttccttcagaatctactgactaccaatgtaaactcacagctggagagccacatcccttgtccttttggaccatggtacctatgaccaaggcttaggccttttctgttgagtctctgtctttggggagggggataagttcttaaattcagggccagagttccaggaaaggtattcaagtaagacacagagcaaggctaccaattaaaataaagacaatagactttcaagttcaaattctgagaagaatattaaaaattatttagtctacactgtgattttaaagagagaaccatggtagcccaggagggaggttgacttgttcaaggtcacatggtggcttagtggtactgcctgaccagaacttggttctcctgatgcaattgaagagcaatctctggctgtcaatgctgatcacatctcaatcatagaaacatctcctttatttttctgactttatagattgctaatggcaggagaacactatgacttacaagttgagctttcaccttgctggccctggctgggcagacttggcatctgtggttgaggctttaaggtggaaaaacagggcattaccagtgcttcttttcattgaatgtacatttgagagatgcattaattaacgtaaaattgctacctctagctctgagccttagctggcgctccactttgtactgttcaccaaaatcaaagcaccgctatggtttattttttagatatcttgaaaaggataatgtttgaccattcctctccttggctttacctccatgtgctgtgtgtaatgatccagagagaatcaattggacactgcattttaaagataaggattgggattttacttctgggtaacctggtgaccccaatcaatctctgtcttacgaactctctgaagatttgatgctccagtccgcaattaagtcccagcttccaagaatggcaacagatgttgcaatccaaacacctttattaactatttatcttcaaatatatatcaacgatctcttggccaacagaaagagtggcctgccccttaaatggaaaatcacactctttcatcttcaagctattttactttatagtccttttgagaagataaaaagagatctattaagaaagtagctgacaatatataattgctttcaaaatttgccttttctaaaagtagtttttatctatacattgaaaatattgctattaagttgtatacctcaactatacaaaacatcaaatggtatttagggta

SEQ ID NO: 25 - DNA, 27712 bp, Homo sapiens
accaaaggacatgcgaaaacttttgggtgtgatggatatagtcataatctttattgtggtgactgtttcacacatgtgtacatatatcacaactcatcaaactgtatactttaattgcgtacagtttattatatgtcagttatacctcaataaggctggaaacaaaaagtgctctgggcaaagagtctggtgacttaagttctgcttttattctgggcccaagttaccatgtcaccttggccaagtgacccaaccctaagaggctcgggtttttcacctgtgccctgggaggtttgggttagatcgttgagtggtaagagcaaatgctctcaggggccaggaaggaaatacaaatgaatgacataagccaggttcaccgcggagaggggtagagacaggtagagactgtggctacctggagagtgttgcctctgcccaggggggcagctgccaatcagctttggccatttgctgcttaatggaatgtgggcggtgatgctcacgcttcagagtctttaagagaaaccacagctccggattcctcaaatgaaatcttcccgttatcaaatgtagataattaacttcaaaaagttaaaacactgtgcaggccaaggccacacatgtgcagacgagacccagcctgagccccacttgtttgtggcctctgcactctgtgatgcgtggggatgctcttacccgaccaagaatctcttctctacttttagccaaagttgcttccctaattctttttacctatacttcactaagaaaaaatgtccatcaatgcccatttgcaacctgcctgctttccatctaccattcgatctatagagtgtcttaactcttggtagacttgaattcttatttcttcagtttgtggaggagacattctgggcaatcttgccgagttaaaagaggctagtacctaccaaaaagagtcgaaagcaaggactccatcagatatttggataccagtgttcaaagtggcattattcacaaccaccaaaaggtagaaacaaccccaatgactattgacagataaatggataaacaaatgtggtacagtacaatggaataggattcagacataaaaaggaattaaattccgccacatgttctaccagggaggaaccttgacaacattatgttaagtgacataagcgagacacaaaagggaaactattgtgtgcttccactaggtatccacgagagacctagaatcgtccaagtcacagagacagaaagtcaaattcatggagaccaaagggaggaggcatgagtttcctgggcgcagagtttcagtctgggaagatgaaagaattctggagacggatggtggtgatggttgtacaacaatgtgaatgtacttcatgccactgaactctatacttcaaatggctaaatcggtatatatttatatatatttatatacatatatataatacatatatattatatatgtatcccagaacttaaaattatatatatattatatatacattatatattatacattatatattatatattatataatatatattatacattatatattatataatatattatacattatatataatatatataatgtataatatattatataatatatataatatattatataatatatattatatattatattatatattatatatattatataatatatataatatattatatattatacaatatattatatattatataatatacactatattgtataatataaaatataatatattatataatatgtattatatataatatataatacatattatatataataatatatataatatacaatatatattatatattatataatataaaatatatattgtatattatataatataattatatattatatatataattttaagttctgggatacatgtgcagaacgtgcagttttgtcacacaggtatacgtgtgccatgatggtttgccacacctatcaacccatcatctaggctttaagccctcctgcattacgtatttgttctaatgctctccctccccttgcccccatcccccgacaggccccagtgtgtattgttcccctccctgtgtccatgtgttctcattgttcaactctaaagtggtacattttatccattatttttttttgtataaaaaggcaggacacgtctggaattttcagatccgatgatgtaatataagaggctttcttttcagcacactgtgctaaggagccacggctggagctcccattggcacggtgtctctgcaactccctcctcaggctcctcacacacccggggaccccctgtgagtccctaagctgctcttaggcttcacccattttgcaaagtgggtcttggccccagctacactttgagagcttttgaatagtacagatacctgggccccacccttggagaatctgaatcaattggtgtggtggtggaatccggtctccacattgactcagagcctcccgggttattctaatgtgcaggcagagttgagaaccactgaattctgttctgaaaacatcagcaagacctttcatggatattataggtaagtaaatcaaaaccgcagcagacggtgctgaacagatccatggggtgagctgttctggggaggcgggtttatcccgggaagggttctgcaggagtgggtgggcctggaagtgggaatatctgtacccccattaagaggtaagaaatgagcaagccatagttaaggagcgtgtttgttgggagggaggagaaacagggttaggattaagtaataaaacgtgagacaagaaggcctgcaattcccaggtgaagcgcttggagtctttctattcctgggagcaaatctaacacatgggaaatatttgcttctgcagagaacttcttagatttcacttctaagtgaaatcaggtaagtcagtggtaagaaaaatcataatacaagattctctaaataagaatctacttaacctgctgcaattctctgtcaaaatatcctatgccccagtctcaaggtaggatttcattcagaaccgtatctatccccacaaaaccacttgaatgaagttaggtttatttaatttggtgacttgaccgagtcagcttgttgagggattggggatgaaaatctaaagggaaaatactggactcgtgtaaatttagactccttggctctgtcattctaaatgttttatgcaacaaagttggagaatcaatccattgctccaactggttccttttcctaaacagcatcttctccaaatcttgtcatagaagtggtggtagtgaaatgactgtcatgtgcaagcaaatcatgaaaacctatcagagcataatttttaaaaatcaagaatgagaaaggtgctctggagggaacaaaagtctttatttcatggaaacaattatgtgatgctcagaagttgatcaaggctctgaaagtcacagtgcatgggattatccatcttacttacctgtaagtcacgtctctgtcaatcttacctgctcacgggagttggaaactgaaaatcataacaatatcaataacactagccaacttatattgagggcttgctatgttgcaggcgctcttgtgcactttgcatgtatcaagatccttaatcctcacaacaacagcatgtgacaggtactatttttgccatctctagtctaaggatgaggaacctgagatgtagagaataatttcgataatttacccaaggtcacatggccagtaagtggcagactggattcaaatccagctgtcaagttattttaggtcagagcctgggctcgtcatgtaccactattaccttggaagaaggaagaaaaggtagaaacaaacacttagtaagtgtttattaagtgccagctattttatacattatggtgtcgttgaacccctaccacatatccttagcctcatgttacagccactaggaaatgtggacagagagtttaatgactagctagcaaaaggcagcctttatttgtctgaccatacacctgtgcattcttcactaaataatgaaatttcagagtagcattcatgcaagaaagcatgcttagggaagaaagtctcttgcttagagtttcatcctttacttagtgcagttttaaccagtttgcctatctgctttccttttcaaagccaggaagtgtatgtggggtgggagcaagagggaaggtgggtgaattgctggagaaataagtttaatagagaaaataaatgtccaagagatgaggattattaaacaagcagtatcctagctatccatctttgacttctttgagtggaagttttggttaaaagctatatgctttctttaaaggaatcaaagaaagaggttggatgagtttgttagcagcaatgaatctatacaggtctgtagcaacctcaattcttgattcctcagaagaaagaatttgaccgggggacataaggcaaagtgagaccaaggcaagttttatagcaggagtggaagtttactaaaaagttttagagcagggatagaaggaagtaaagtacagttggaagagggccaagtgggtgacttgagagattcaaatgtgctgtttgacttttgacttagggttgtatagtttggcctgcttccagtggggtgtgtctgttctcccctgatttttctcttggggcggactgtctgcatgtgcagtgggcctgccagcacttgggaggggccgcgtgtgcggtgtttactgaggtcgagtgcatgctccttggaggcatttttcccttaccagtctagggttcctagatgaaggtcacataccagttaaatgaagtccatcgttttacctctcaatgcacatgcttgagcccactcgcccaactcctgagatcttatcgggaagctgctgcctaccaggttcgggtgttttcttttcttttcttttctttgttttttttttttgagatggagtctcactctattgcccaggctggagtgcagtggcgtgatcttggctcactgcaagctccacctcccgagtttgcgccattctcttacctcagcctcctgagtagctgggactacaggtgcccaccaccacgcctggctaatttttttgtatttttagtagagacggggtttcaccatgttggccaggatggtcttgatctcctgacctcgtgatctgcccgcctgggcctcccaaagtgctgggattacaggcgtgagccaccgtgcccggccaggtgttttctatctattgggagactgcctttccctggtgctgggtgcgatcagttattattttagggagcagtggaacaacttcctgaccatcacctgatggttgtctgacgttcctggggtgggggtgggggtctgccctgcttatgtctgcctaactacctactgttaacaagttaatcagataaatttagtaagctttcaaaagtttgtataaaaataatccttagttaaatttagaacacaaaattaagttcaagtgagaacttttctaaacacagaaaacagttttaactcttcaaagaatacattgccacttactctaaacaacataatatcaatacaattgttattccaagattattaaacatatatcagaaggtatgcagagctcagatggtacttgtgggtatgcctgggcttgctctttctttctttgtctgcctggtgaacttctctgcagactcaaggacaaggtcttcgggactcttctgagaagtcagccctactccttctcctccacccgtcactgccctgcagtattctggagctgtggttctcacactttagaggacatcagaatgaggagggcttattaaaacacagattgccagcgccaccccaggaggttctgcttcagtagtctgggtggggctccaggatctgtatgtcccacaagttcccagctgactctgctgctgcttgctcagtgactacacttggagaaccactgccccagagaaaactcctctctcgtctgtgctgccctggcctattcagtcattttattttgacttgggccgagcagagaatttctgtatcttctcaagggtctgtgatcttctcgaagagagagtcctgttttcaggccttggagaagggtaatagcagagagttgaggggcttcctgggagagggctgtggctgatccagggctgaggagtctatccagtaacaaaggtgtagtcacaggtctctgaaaactgcatcccaaccccagtccctgctggactcacaggctcagtggaaagtagagagctgtaaacacagaggtagttaaaaaaaaaaaaaagtaatggcagaagctgccctctctgcgaccctgtaagaaagcatgaaacgaggcagagaagcgtcttttcatactcccagacaaacctcgcttttgtcatcccaaggaatttaggccattactcacaatgcctgaatgagatgatggtgcccgacagagccgggcatcatcaagggctgtgctgcccaatccagtagtcattggctacatgtggctgtatgtatgtaaatataaattacttagaactaaagaaaaccacactagtttcatttcaggtgctcagtggtcacagatggctcacggccaccctgctggacagttcaactctaggacatgtctatcattgcagaaagttcagtcggctagcactactggagggacttggacaatgatgccgcaagagcaagatggtacacaggaaacccgatgtaacgtgtttgtgcccctctccctgcatgctgttctgtccaagaatttgcaaagactggcataccccacagaatgatgcctgggagcatatgatgcctctgcttctcctttttcctgttctcatgagccagaactttagtgccaagtgtggttggggtacccgtgagtcagaagaacactgttggagctgagagtaggattgcccctggtcaggggtgagtcactctctggactccaaaaggtccaagggtccttaacatggggctgaatgcctgcccaatgccaaggctgtcgagtcatactttttcttttgttcttttttttcttttttggagatggagtgttgctctgttgcctgggctggagtgcagtggcacaatctcagctcactgaaacctctgcctcctggtttcaagcaatcctccccctcagcctcccgagtagctgggattacaggtgcccgccaccacgcctagctaatttttgtatttttagtagagatggggttttgccatattggccaggctggtcttgaactcctgacctcaggtgatctgcccgccttggcctcccatggtgctgggattccaggtgcgagccaccacgcccagctgagtcatgctctttctatttcggtcagtgttacttgtgcctcaccttgcttcttctgccgcaggaacctcccctcccctctcatacgcagcgtgcatgcctttctcttgtcattgctctttgaaagacagcctatgcatttgagttaggatttgggaatttaaaaggatggcaagtgaaaaagcagagttgggttatctggatcaatgatagagtctccaagacctggtctggggctctatattcagtaatgaggtttcctagcctcccctggtgacacacccaggtctgataaatctctcaccatagacaagtttcccagcagtagggagcttaaatgttcctttacctaattcttccataactcatcataaaatgggaaaaaaaattctaatttcctcctggctggctaaaacctaagagagatggaaggaaaaggtgttccagggtgcttttgaggttgcacgtggacctgagttttagcagatgggcctttgcctgcctctgccatgggggctcgcagctcctcaggcctcggtatcacagaggtcttagtcaacgggtgggtaacaaaacatggacgctgctttggcacacagggcacactgaggggagggagaacagtgtaagagaagcatgctcagccagatagttgaaggacgtccctcgtaagcccaagctgtgcccacaattgggcttttaaaaggtctagaatgggtggtggtgggcaaccagaagtttgtttgtatgagagccagggagattaattattttaagaggacaggaatgagggcactataagcttgaattggtcagtgcaaggcctaagctgggatatgggaggaaatcccacatgcatggcgctgtctgccagtcaggtttgtctcccaatccagattgtggagggaaggaggagggtgagagcagagctgctacaggcatcctgtaaaagctgtttgactccaaactccgtgaaacatggagcccaggcagcacactgattggggaattctctggccaactgtgacgaagtaagatgttgagcagaggcattcttccagagtttcccgcagaacccacatggctttggcccttggagagctccaggccatcagagatggtgcaggaatggggtaggagacagaggaagccctgcaggaagccagcaaaaacctcacctaccttgagaactcagcaatgccggaagagattgagattcctagagaatggaggagccgggaacaaaggagaaggatgggatccaggaacaggccaagagaaccagctcgatgcttcttcctctcccttctagaaaattctgttcagaagccattaggtaaggtagagcaaggcaggcctctgtagctgagtggggaggaagtagcgtgcccagagcaggagggtggagtccaccggggtgagatagaggctcacacaagggcggtggtccagtgtgaggttgcccatgtggagcgaggagggtgccaacataggagggggcagcccagcatgtgtcggagaccaaagcagggtccgaagggggtcctgtccagggaggatgtcctggcacggagactcagaccctcagtggggtgaggaggggtctacacagaaggtggcccagggcaggatggcagaactagaggggtgaggagagtgtctattgcaagggcaccttgcgcttggagtcagtgccctggggaagtgggaagggcatccacatggagggtggcccagggcaggatgctgctgtccaggcaatggaaggaaggtgtcctcaggaagggtggtaccgcatgagtgtcctacctgagcagagagaggaaggtgtttcagtgaccggcagggtggctgagaatcccactctgctttgtgtcctgagcctcacagagcacaaggcatttagtagctgcccaggtaatggtaattgttaaatggatgatgaaataaatgagaaaaatctggattcaactctcatcttgaccatatattagctatggaactttggatatgatcttcatctccatcagtgggatactgtgtatgaaactactcagaaaagctaaaggagctgattttactccacctaacaggaaagaaggctctgccattctttgctgtgcaagcgttcctcatatcaaagaatggcagagccctctttccctttgggtggagtaaaatcagcctagccttcccttagcgggtaccatgctgcccagcctcaggtgcgtcctttgtgaggtgagaagtgtatggagctgctgagtgatgtgtggctacagtggatgcggagaaactcacctgcagggagagaacaggctgtggccattggtgtgcaggcctgtggactttccgcatgcgttgttcagcttattcagccttggtggtctctgagatctatggcagtgagcgtctgctccctctcacagcaaacaccacactttcactgaaaaatgaggctattagtcttgttcacagagcaccaggatccctcccagttctttcatgtgtttgtttgttgttttttgagacagagtcttgctctgttgcccaggctggagtgcagtggcgcaatctcagctcactgcaacctacgcctcctgggttcaagcaattctcttgcctcagcctcccgagttgctgggattacaggcgcctgccaccatgtctggctactttttttgtatttttagtagagacatgttgtattttagtggagatgttggccaggctggtcttgaacttctgacctcaagtgactatggttctacaatccgagttctcctgttggaccagtcgagtgaccttgggcaaatagcctcctggcctgggcagctgaggacagtgtgtgagctgtgttctgaggcctcaggcctcagaatttccctcctgacactgtgggcctgagcagacagaaaggacaaacttcctgcccagagcgtgtggtctgaaggtgcctcggagaccctctgatcaatctttgaccccttcccccacacacactacagcagttacgtgtctgttaaaatacacgttcataaaagaccacctactaaataatttttaagttgttattctaaaccaaactattttgaacttttgtaaatgcagtttttatttttaattaatgacattatctttgcagccctgaatcagactttcctggacacttttgggtgttcttatctgcatcaatggggcctcagttagcattttaaaggtgacattgccccagattttatctccaccagatcttctcttctgaactgcagatccagatatcaaacggcctcttgcacataatgacttggctatctctcaggtcctccctgtccacagggtgggttctcaacttatcaactccctcctctgacaccactcctcccctgaaagggtcctcccactcccctcagagaacagcagcactcacagcagtcagcccctaaatccagctgatctttgtctccattgccaatatcactgttccaggcaccatcctctctcgctggtattactgcaaactgccacccagctggtctctccacctccagccttgccacgctgcccccttgccccgtccatgtcagactctaccacgctgacctttggaaaatgtaactctgtatgcatcacttccctactgaaaactctgataggtcactatgccctttaagataaagtctgaaatcctcagcagggttgataagcagctctatgtgggactcgcttttccaggttagcaagggacttccctgattttagcactgaagtcctgaattctccttagtccttggcaaactggatggctcaccactcccctcttctcctcattcctctgcctcacccctaccccacactcaccctctgtctgtcccctcagcagtcttcctcctgctactgtgaatggtctctgccccagcccctttgctttgtaactttgagatccccctcctagtctcagtgggcagatggcttcctccatgctgtctcctggacaccccgggtcaggtgactcgcccctgctgggtggcactcttagttccccttgtggcacttaaatgcgttatttcaatcactgggttaccggaggtctccttccatgactgtagatgctgcaggcagaagctgagtcgtgtttgcccccgtcatcacctgttgtctggcacaattgcctgctgcggatttcagtggtgatttttaggtgaatcgtgatgcacccaggcacagcctatacacagaacgttgtgtttatctgttatcttggctctgagacaggcagtctcagaaagtgaaaaatagctggtttataaatacatgataaaatgttgacaatcactcataattaagtagacatacattaaaataataacgttcacttttttcgttgagacagagttttgctccgttgccaggctggggtgcagtggcatgatcatggctcacggcagcctcaagcttctgggctcaaggtatcctcctgcctcagcctcctgagtggctaggactataggcacatgccaccaaacccgactaattttttttttttttttgtagagatgggttttactgtgttgcccaggctggtctcaaattcccagcctcaagcaatcctccctccttgacctcccagagtgctgggattacaggtgtgagtcaccatgcccggcctaaggttcattttttacctactagattcataaaggtcacacaatgtgaagaagcggaggacaccagcaggcgctctcctccctggggtagaagcataaatctgcgagaacccttgaagagtaacttggcaatctttcctaaaagcttacctgtacatagttttttttcacagtttcactcctagaaatgtattctacaaatactcttagagatttgtacagaaaagagcaaacaagaatattcaacacatcattgttagcaatgaaaataaaagggaaaaaaataccctacctatccatcaaaaggaaactcgttaaataaattaggcaagtccttctaacagagtattataaaggaattttttcaatgaggtagatttacataaggttatatgaagcaatcctcaaagcagggggagggggcaggaaatgaaaaaggtctacaatttgtttatttttgttgtaattttaaaaggaaatatgcacatgtgttaatatgcataaaaatatttctggaagaatacacaagaaactcgtagcagtaattacctctggggagagagactgggatctgggataggagagaaatttattcattctatattctgtcttaagtgtttaaataatttattacaggcataaattcaccctttttttttttttttttgagacggagtctcgctctgtcgcccaggctggagtgcagtggtgccatctcggctcactgcaagctccgcctcctgggttcacgccattctcctgcctcagccttcagagtagttgggactacaggcgcctgccaccacgcccagctaattttttatatttttagtagagacagggtttcaccatgttagccaagttggtcttgatctcctgactttgtgatccgcctgcctcggcctcccaaagtgctgggattacaggtgtgagccaccattcccggccataaattcatttttcaatactacaaaaagaaaactccgtgtttttttttttttaaagaagaaaaaagctagctagaaaaaagcatctgcccgaggttctagcaattttccttccttccttcctttttccatcttttcttttttttctttctttctgcccatgctctcctcctttctaagaaaactgtctttccagaatcttctaacaatattaagtaataagattagactagctcttcgtctctgagctgggagtccaggctggactgggtgagtttacccttgcgtgaggctgagtgctaatgtctctcacttactaatggggtaccttgcagcctgcctttcatcctcctgcccaccttctccccagccatgtcctggcatcagctgcaacagatcccagcttctcactcctcccactttctgctcaggggctcctctgccaccatgatgtgagatgctgaggacactcattttgtcattgtgatatgtttggaaacctggctgtgggagagggttaacaacccccgggatgacctgtgatccatggggtcatccctcacagcttgctaggggtccccagcggtatcgagctccagtttctcactggcctgaccagctcaataatttaccttggttggcttgtcctctttccgtttgactcttccgagcctctcactcctgtttcttgggatcacttttcaaagtaaaccaccatgttgtgctaggctctgcttgttgcagaaacccaggctaagacaccatctttcatcactcctggagagttctggagtccttgtagacctgtggattaagaccacacttcattcaaagagatccaacaattttccctgggagttcctctctctcgctttctcttcctgagatgtaacctttcccctctaggtccttaggcctgcctttcttcctctctattaatgtgaggatggcattttgctttgtgcccccccacctcaaattctgtattgaaattcaatcagcaatatgatattaggaggtggggcccttgggaggtgattagatcaccacctttgggataggatcaatgcccttattaaggagacaccagagagctgcctggtctcttccaccatgtgaagacacagctagaaggtaccacctctgtaccagagagtgggtcctcaccagacaccaagtttgctggctccttgatcttgaacttcccagcctccagcactgtgagaaataaattcctgttgttcataagccacctcgcttgtagtattttgttaaagcagcctgaatggactaaggcacctttataaacctaggcattctattctaaaattgccttccagtccaacagaagcatgttatagattctccaggtagaagcatttgttgtaaaaattaactgtacccttgacattgagatcatcttgtatcaattttagatccctgaactctgatttgatgatttaaaaagcaggagaacctctgaatctaactcattccagtccctgcggtggaaggcaaacatagttcactcatttggaaaccaaggttccctgcacagaaagtgccaggccaacccagcgagccctgatgcaaggtcactatttattttgtcatcctgaggcgagagttccttcaaggggctgctgttggctttcaaacaagcctggaaaattgtctggtggcctctttgatcctgcccctttttctgggtggtgctctctcttttctctgtgttccactttcaaaataaaccatctcagttggctgtgataaattcagtgaaggaaatttcaagttgagaatggtgagaagacctgcagaagggaagctataaatagcccacttttaatggctatagtaacataattccctttacattactgtctgccattaagcaataagtaacattgtaacttgaaaatcggaccaaaatagattgcaccatctacccagacccaatatggtatgtgtaaatatgcaacactgccctattatttatagatctatgattttccttatgaaacggattcatttgggtgctctgtagacctgagttaacttgatccaacaaaatccaactttgtcatagaaacctacaagtttagagcaagggggacttttaggaatcacggagttgaaagcctgtcctttgcctaagctcatgcagggacacagggatgggtacatgtgagaaggaagtagagactgattccaactgaacacctggagaaaggcctcggattctcagattcaatgaaaggggccttcacatgcctttgttatctatcacaacatgagatctggaggctgcaatcaccattgttcagtggaggaaataggttcacagagtgaagtgacttgatccaagttacatagtaaatcaatggcaaggaattggactggaacccaattccaacttaaggctagtatttttcctttcatagtggtagctccattgtttctggcttctagagtcttgggctggtcagctttgattgacacgtccacagtaagagtcccagccctgccccgcctcccacctatacctcagcacctcagtaggtttctgtgacccctccctttcttagcctcaggtttgttcacactacagatggggtgagccaccccaagcccctatcaccacatcgtctcccactcctggccccaaatgctttcccctggccatgctcctttcttattattctgaaccccttgtcagttgttttctgtactttatccctgaatagtcctttcaaaacagaacatttacaatttccttctttaagaaaagagtacttaaaaaaacaaaaacgaaagccacgtttgtgattctcgcttcttccattacttaccttctaattttccaagtcttggcttggcattcagggccccctgtaattaggcccctgcaatgtggatcaccttctccctatccctgtgttgcttgtacctctattacaacattgcacacgctcagccctgctacctctattacaacattgcacacgctcaggcctgctacctctattacaacattgcacctgctcaaccctgcaatattccaactaaagagcatgggacactgaattcgtttttatgtccagtagaacatctgccacacagtcacgcacatagtaggtgtccagtgacagtgtattgaatggaatgggctcattcctgcttcctgcagcatggtccctatggcctgtctagagcacatctttctatctgggggcaagtttgggcctgtcaccccctgcagtagacactaacacacaaaggggtgagattagcccctgtgcatagttccaaagaacgagctggcctaaataatacttctgagtgtgctaccagtgcaactgagttatttcttaaaccatcacatccaggtgcctagtatgtttctaggaactttatctgaaagcatcaatttctgtcactgatcccccaaattgtaattgctcaagaccaagtgaggactaaaactccgcaggcatgacagccctgtgttttggtgctacatgcggggggactgaatgtcttacagaggagcttacagtctaatggggtggggtgggcagggaaacaaacctgcagagagcgacaataggcaagacaagagcatgaagagagacactgtgtatgggtaggggtggctgggagaatgaggattacatgacagagtttatagaaagtgcctggcacatagtaggtgttcagtaaatggtaacgagtcatattctcactaccacacaagcagctgggttcacagaggatcaaggcctgtgcctccctctgactgccatgcctcttcctcccctatcctgcccactccctctgctccggcctggtcttctgatcatgaggaacatgccaagttctttctttccccagcagggaaaagctattccttattccagaaatctgtgttcccagcttagggcaagactggctgctgcttgctctttaggtctcagaataaatgccacctccccttgcctgaccactgcactgccctgccccagagttattctctatcacatcacactggctagttccttctttgcaattaccagaagctctaaaaattttgtttctttctttgcttgttccttgtcccactaggcttcaggctcgagacagagaggaaccgcctctgtgtttttcactgtcgtgtctcagtgctgggagtgtactccatgtggtcagtgtgtgatcaatttaactgtgcctgagggttctgagaagacctcacaaatgaaggtacctttgaccagagccacggagaggggacaagagtttacccaccaggcgctgcaaagctgaggtggcaggtcaggacttccagtgagaaggaggtactggtaaaggagactgttattatgagcagctccgtccaggagaagccagggttcctggtccaaaacagcaccctaggttcaaataggaataccctggggttggaggtgagggaagggtggtggacagctcactcagctatcagaagctgagggataagtccccttcctccaatctgggctttcttagcagccttttgagctggaatttgttttgttttgttttgtttatggtgggacctacccactgtgcagggaggatcttatcaggtggccaagcttgttttttgtttgtttgttttgagatggagtcttgctctgttgcccaagctagagtacagtggtgtgatctcggctcactgtaacctctgcctcctgggttcaagcaattctcctgccttagcctcccacgtagctgggactacaggcgtacaccaccatgcccagctaatttttgtatttttagtagagacggggtttcaccatgttggccaggatggtctcgatctcctgacctcatgatctgcccatgtaggcctcccaataagcctggtttttggaacaatacaaataatgaaaattttaagtactgacatttattgagctcctattgtactattttacacacatctggtttaagccacagccactgcacaagattggcatttttccccatttccagaggctgaaactgagattgagtttcatgtccaaagagtgagtaacatgtgtaaagtcatggggctaggaagtggtggatggagtttcaaacccagctgtgtttgaccctgaagccagggcgctaaaccacaatcttttttctggccagtgtatctcacaggtgaatcaattcactgggtttggcgcattcccttgtgggctgagtcaccataagtcagactgcctgaacctgttcctctctgggaggctgatagaaacctaatctctaaactgacaatgccaggggcaggactctggactttggtaaccccatgatggggtggctccctactctcccactcagagctgcagatagcttttctccaggacagcaggactcaagggtgctatgggggttagttattgcagacatcttgctttgctttgctgtagagtggggtggctaagagcttgggtagaggcagacagactggtttgaaatccagcctttgcacttcgtagctgtgtgaccttagcttgggcaagtttctttaccgctctgtgcttcaactctcatctttaaaatgaggctgagaacagtctcatggtgctactgtgaggattacgtgaaaaaacgcgcttgcacatagcaaaccctcagcaatcattagcctttatcattgctgttgttgtgactggtatatatatatatactttttttttttttttgagtggagtttcactcttgtcgcccaggctggagtgcaatgtcgcaatctcggctcactgcaacctccgcctcctgggttcaagtgattctcctgcctcagcctcccgagtagctaggattacaggcatgcacaccacgcccggctaattttgtatttttagtagagatggggtttcaccatgttggccaggctggtctcaaactcctgacctcaggtgatccacccgcctcggcctcccaaagtgctgggattacaggagtgagccactgcaccccgcctgttgtgaatagtcttaaggggaggcgtagtgggatgtaatgggctggagtcctaggccaccactttttagccatgtgacctttgagatgaactattaaacttcatcccagaatctttctaaattctccaaagttaaagatgagatttaatagctcatctattaaagatttctgggatggcattcttaaaattaagattagcttctgttaaggaattagaaaacaccagaggtagggaatggtccctgtcacatatagacagcatttgccctaaaccatgctctggtcaagaggaggctgaggacttctgagccatttgcctctcatcagaacgtcctgggtgtagtgtcagagagtggctgtattggcttgtctgaacagctagtgtgttgctttggtttgagctgaaagattgttctaacaaaggtgcatggtgactatggtcagcataggcgttaggagaggaggggccgtctgtgcacactgtcctgggtgtgcccatcctcaggagctcagctgtgtagtgtgtggcagcctgtccccctgactcccgccggtgaggttcacagatggtcagagctcccaggtgcggctctaaagctctggctctgctgccgtggccccaggcaacctggctggctcatgggcttcagcttctcacatgtggaagagcacagatcatccttcaccccagtatcccggtagctgacctcagactttctgagtgtgagttgacttgagtagccctgagatgctgacgtcctctgagtacatcaacaacagggagtttctgggctgcaggctgagaacccgtgtttgtcacaaggcggccccacagagttaccaccactctaaggccctgccagagccagcaacagattattccagaaggcacctgtctcccaatcaccttctctatctggaacaacacctccctcagggttgggtaaagtattaaatatctgtgccttgcatacactcactcagtgctcaacaaatgctggttctttcccagtttctgtaatctgtatgacctatcttgaccaagagattgtcatcatcctgaggcccggggcccaggctgctgttgcgctggcctctctccctcactctccagtaagccctgtcccaggctggcctctccctccggggctgtcttatccacgcttgggctccaaccaccttgacccttctccacctgtcagtcacgccccaggtgttccctgagtcacgcaacagctatatagtagctccgcagaccaacagcaggccgacagcgtagcacctgagttctagatctaccactgttcatgcgggacctggcataaagcattcccacgtctcggcctccatttccccatctgtgaaacgagagcactggtcagctcttcacatgcagcgtttgtgggatgaatccttccatctgtccatccatcccgccaacatccatgcacaaacatttagcacctgctgcatgctgtcagggactatggcaggaaaagagttgaaacagacacgtcccaggcctccagcccctcacaccacggagaggaaacagatgcccgcaaaggaggaggcacccctcagggggccagcgctgcgacacggtggaggcagggaggccgtctctaagcagcctgcgagtccccgcgctgcaccgtggctttgaggagtggcgggggccgaggggccggtctctcttccgggggagattcctcccctcaccccggcattactcagcgccctgaactgtctgcctccctccagccggccctcctcgtcttcctggagcgcagcacaaaggtcctgttgtggccgcggcccgggccgcgggcgagcctctctggatggtggtgactcagtctcttgccatttcctttgtgcggctccggggctcctcgctgggagcggagtgtgtctgcagggctgggggcgggagccgggacccacagcccgacagcgagcctttcatgtgggcagggggcttcccgcacgcaatgcgaacctacgcctggagcttcccaaagacagcgtccggcgcaggaacgcgagatgctggccgcctcgcctctggcccccgcgagcatcaaagcgcgtgccgtcgagggggcacgtgtcccccatcgggcgcgcctctgctcctagtcccctgaatgaacacatccttatgaaaagtggaaattagccgccgaagggaagggcccggagagcttgggaagcgacctaggctgccagcctcccggcgggtctttggtcccagctctgatgacctgtcagcagccgcaggacctgcgcttaaaggcgcctctccaggcctggctcagggtggggctcctcgtgctcagcaccctggtcaaggttagggctgggtgtgcgctggaggcttggagtgccagggcacccagtgaagagcgaatgaatgaacgagtgaacaccggactgggggcctgcagacggttcttcgcaggttaattagaaggcctctagcaagctgcagcggaggcatttcaggcatccttcagagaggaccctcggcctggctcctaagggcccctggtctggctctcaccccctgctctggtggcatttctgctcactcagcctttaccctttacacgccagccgctctgaacagtttattcttctgggagcacatcatgttcttgctcacatccaggttttgcgtaagctgttcctgctgcaaggaaaacccttcctgtgtcctcctcaggtgagagctcccgcaggcagcttctccccggagtctggcgtaagtgttcctcctctgcacgcctctgaggacatttgcaaaggtctgtcatagggcttaccaccccgttacctgtttgtttccaccagggagtgcgctgaagctgagagggaatgagtgagtgaatgaagggcttgagaaaggaaatttcttcaccctccagtgccctctgggtgggtattgagacaagctctacaggaagcctaagaaaactaactgctctaattctgtccttccttttgcaatgtttaggcaactcctgtgcatctgtaggtaccattgtgaggttactgccctggactggggagagatccacacacgcaagagtgcatctggcatcagtatgtaagagtcaaaactgacacacagttcttcatctcatggaaatgaaaacatgcatggccggaatgatcttatacctgcttctcttgggccaggtcaccaggctggccctgagaagtatgtgatggcatggagaagaatcctcacacatccttgcagttctctaggatttgcaaggcattccccccattgctggactcactggatttgagtaggcctgtctgcccctattttagagatgagcatatacaccttacaaaaactgagtcttgctcaatgtctggcaaagaagtcttcctttatccaacaatcctgagagtctagcgggtgttgggcaccataaagatgaatgaggtgcggttcttgccaccaggcagtgcccgggcttgtcagggagacccatgtggagcatgacaattgctaccttcttgatacgggcaaaaggatgttgagtccagtggaaggagaggcttgtctggctgtgagatcagcaaagtcttcacagaaaaggagaattttaaatggggccttgaaggggaagtgtctcctggagatggagagaacatagcgaggagagtgcggtgaggtggggggtggcaggggaagcacatcactacgcggtgcttagggccgagtctgagccaacctgggagtggcactcagctcccccaggcccccgagatgcatgttcagcagcatccagcggcctcctgtgaagcgactgggagtccacagagacaacaaaagcagatgtagtgatgtgtaaacttgaagtttctagaagttcctttgggccccaccaaatctctgtggcaatgaaccaatcccacatgttcctgtgggtaatgctcccagagggcatgtgactttgggcatcattattggctgaaaaaggaaactggggtagtagttagagagtgctatgaactgaatgttgtgtgcctcccaaatctgtacactgaactccaaatcccactgtggtggtattaggtgagggggccttgggaggtcattaggtcctgagggtaaatccctcatgaatgggatgagtgccctcacacatgagaccccagagagctctctggcggtctttctaccatgtatggctgcaatgagaggtctgcagcctgcacctggaaggaggccctcaatgaacctgaccagactagcatcctgttctcagacttctggcctcccaaactgtgagaaacaagtttctgttgtgtataaaccatccaatctatgatagtttgttatagtagccaaaccgactaggacagagaggatgtaaggagccagtggaggactcttttaatggagagactacagcatgtctcaggctgaatggtccagtagggagagcaaaaacagtgcccatgcatcaccctgaggtctcacccaaccctgctggaactgactttagtgccctcttccagtgttccccgcatgacctggtgggtgcacacctggctgcttgcattcacaccgtccctctccacttcttccttctccccagctctcttcctgtcaaccctggcattgcctttgttggctactgagagaagaccagaaatatccatctagtcagacttgcctgctcctgggaagaaaacaaaaatgcaaagaaaaggttctcagggagattgagccaacctgggagtggccctcagctcctccagtccccagagacccatgctctgcagcatccaaggggctcctgtgaaactgttgggaggccaatgacactctgtcccacgttgtggatctattttgtggtctctgtatccttcactgctttttgtggacattattgtattagattcctttggaaatgatgatccagctaatggccagttagtaggaaacatcacgaccctccccccaaattccagcctcttgctgaaagggtggggcctgggaaatcatatggtattgctcctggtcaccacagaccagtggtggctttgggccaaattctggcccagccaatcccccccacctttttttttttttgagagagagaatttgaggtaagagacacagagactcaggttaggaggatgcttgaactgaaaggtcctgagacagcaggacaggagctagtaccatgcagaacacagcaggagccacaggcaagcctgaactgtgggagagagaaaacgaagggccttccagagaggtccagtctgccaagaggagaagagagttgacacgcagaaagagttaggggtgacaagaacccccgtagccccttgaaggacacagagaggagatcttttttgttcttttgtgattcatcctttctcacttcctgtccttggaggtcaacaacagacccctgtatccttttaataatccctcttttcatttgaaattgttccagagggtacctgatccttgttgccagcatgccctgaataagaaaaatgctcaaaccaaacactgagtctactgagtctatgtgaattaattcttggaattccttggctcaattcaataaacatttcatgcacaatttttgtgtgccaggtgctagaggcattctgagaaaaactgagacccaggagctgtcctcagagagtccagtaagatgtggtctgataagacatgtttccatatacccagaatacaaggtagtttgctaggagcactgcaagagaaacgcagatggaaggctggagtgtgtactgccactgtggaagcaggaggggcttgagggaagagggccttcaagaatgggtggaatctaatattggaaaggggaggaagagtggaaagtataagaatcagaagtctggttgcaggatggggcatgatatgggtgggacactgtaaactgcacagcgtggaaggaatatggagtttagaggaataatgttagatgagtctgtaagacgggcttgactgggattatgaagggccttaaaggtcaagccaaatttgttatcatagaatcataagaaggagaagagccttagctgttgtctagtctaacttaggtaatttggttccagttcctcttaaggtggccaccatgacagactgaatctcaagtactcatctgagatacagtcatttcaatggtagtgactcagaatttacttttctttttttttaccccagcaaaatatttattttagaaaataggattatattatttgttgctctccaacttgctttttttggacatcttggacatctttctctaccagtacatatagttccatttccttctttttattttatttactttattatttttgtagagatgaggtcttgccatgttgcctaggctggtctggaactcctgggctcaagagatccactcaccttggcctcccaaagtgctaggattacaggcgtgagccactgcagatatttttattttttattttcatttatttcaatagtttttggggagcacgtggttatttgattacatggataagttctttagtggtgattaccgagattttggtgcacccatcacccaagcagtgtacactgtacccaatgagtagtcttttatccctcgtcctccttccccgctcccctcacgtccccaaagtacattgtatcttatgcctttgcatcctcatgagattacttttctatctttaacaacttaagagttctttccagaagagtcctcttactacgaggaagagtgttagagcacagggaactgggcctagagagtctgcagcaaattgtctcaaatagcagcttaaaaaggtaaggaacagaaaagaaacactctctatctatgtgctggcctcaggcacagtgcttctagatggtagaacatctgtgaagtagaaattacaatcacttttcaggtgagaaaacaggagctgtagggaggagtcggacaggtccccaggcccagcaactataccaggtgaggcaggaatgtggcctcgtgttgaccagattccacagccacgggcttccatccctcttctctgcttgctttaagactaaccaccctggcttcaagtaagtatcactcacaaaggaatttcaaaaagacatgcacataaattaatggctgatggctgtaggtggtcgtatgggaggaaccgattataacattgtatgaacttagcaaagctctaaaccatagcacagacatttggcaaaatggttactctttttcaatcatccaaggactcagtttataataagccttgagcgagtccctaaattccaaagcccttagcatcttccaggaccctcttgagaccacacagtgcttccagcttccggaaacagcagatgctattgcttccatgagcaatgtcagcatttaatacacaagggggaacagagaaagaaacctatatggatggggagcagggaggaggggcagcactggatcctctcctgggccctgtccagctcgacattcctgaacagagcgtgctgttccctctcctgatgttggcagcttagaatgcaggagccttagatgggtggcctggaagggaggccagcagggagaggtgacctggaagtgaggaagctcaggagggactgatggtaattggaggggcaggcagagagaggcagatgaagaaacagccgaggcctgtgtgaaggctggacccaacctgcgtccaagcagaaagtccagagaacttagcacagcttccaaagcttcagagtacatcagaactacttgggaagtgcgtcaaactctggttcctagggaaatcctcagagatcctgcatctgcgatgaggcccagaagtggtttttgtgaccagttccaaggcgacttcatacaggcagtccttggggacactggtgacaggatttccctctctggaccttggtgtcctgctctgtaaataaaggggtttgtcaaagacggtttctgctttctctgtcagctccaacatacagcttctcaaaagcttccaaaaatccccttacccaagcttgcagccctcatcacctgtctcaagataatggtttcctattctttttaatgtataaggcagacaggtggtcatgtacctgctcagctcttgaaaaggacctacatgatagactctagcaactccacctcgtctgcccattttgggggagagtaaagccacgtcgtgtgcgttcacataggcatccaaatgggacagacttcctctctctggaggccgtggctccaggtcaaaacaaaaccacttccaggtctcaggtcacaggatcctgcagaatgatttatttaaggaagaaagcttcaagggctccagagaaattaaatgtgtatatttccccagcaattatgcacgtcctttcccttgaaaaatagttcccatgccctgcctggaagaaaagccagattctccatgatgctgtgttccacaggcttctagaggtgggggggctgtgattttctaacaggagaagccacatgaaagtcttcagcagctttgcgctgtttctgctgcagcacctctcagggcagactggagaatcagggagtcttgtctggaaaaacgagacaggctgggcctgacacattgatttctggttcaagtttcccagtgaaatgtgaaggaggaattttccacttcttgtcctgattcaccttggcgaaccagtctttggagtcccagactg

SEQ ID NO: 26 - DNA, 1863 bp, Homo sapiens
cttcctcggggtttgcttccaggcctgacttttactcccctttctaagtgtgcagatgggatgtgcttctccacaggaggccccacggcttccccacccctcagaggagcgccgtgcgtgcgtctgtgtggaggattggcagctcctgcagtcggcccttggtcctatttggcgacgcctctgccttccccttaattatacagtcatgagccgccctggaatcacggcagctccggatggatcctggatgccagaatgcagcctcagcacggggctgcaggacaggagtgagcgaggggctgcagagccggcggccgcggtgggcaccatggagggggctgccctgggcagcacgggcatgagtctcaaggcccaggtttgagtaacaggtgttgagagcttacttacttttcctgagacacagtttcctcatctcgagagcacggaaaatcattctaacttcagaggattgttgtgaaagttaaatgagattaaagaggtaaagcccatgacgtgcttagctcgtgcttggctcttggtcaatgccagttagcgctgcattttctcccctctccctccctccttctctctttcttttcttctattctccattcctgttttctcccccaccccactccccaaagctctgcgttgagaaccagatgctgtctggtgggttagggccagaggaggaaaagctgcccgccgtgggctgcacccataccctcttcattccaatgacatgaggggaggggaaaggacagaggtagactgtcctcccctacctcctcctaatacaaatggaattcctggaactggaaaacaaagaatacccccataaaaataagacagtacttctggtgcggtgtaataaaggggaaagtaaccctcaatgtcaggaaactccgcacctcccagctcatatttgtgtggaggaaaagttaaatattaatttggactcaactgaatgtggacacaaacaatggtcaccaagtcccggaacaggttgtgtgagcctcttcaggggttcatccagcgctgttttggagaaatctctatttcaatttattcctatacgttagttactgaaaaacaacagacaatcgcaaaagcaagttgcccgttttgtgttccttgagcccaatcatgaagtgccgtcgtgactgggcctcatgacaaacaacttgtaacaagtaacaacagagctcaggtcccagaccgcactgaagctctgtgagacctctcctcatctgtgcatgaacgagtgtctgactctggagcccagcctgctgcttcccagtctggtggtgaatcctccgtagtctgatggaggtttgctcttgttgcccaggctggagtgcaatggcacaatctcggctcactgcagcccctgcctcccaggctcaagcaattcttacgcctcagcctcctgagtagatggaactacagggcatggactggaactcccaatacccctgacatgggctgagtcaacgtggtcatgaacatgtgacaggaggcagcagaagttgcagagaagagtgaggcacgtttgaaaaaggctgaaaaatgtttctgtccaggcaagggtgtgtgctgaatgactcaaggattttttgggcaacacaaaccaacacgagccgtgtgaggatcaggtgacagctgcccaaaagctgacacaaggaacaagcctggaggagtgaggatgggtgctgtgaaggaggttgtgcagctgggcccgcagtcggacctggtgagatcagaggagggggtgccaccagtctgtggacgaagatgagaagctggaatagagcagaaaacaggaggctgccactctccatctttcccaaagtcactccagga

SEQ ID NO: 27 - DNA, 1402 bp, Homo sapiens
ctgtctcaagcctccaatcaacagatcagacagcttgtactcacaggccaaggacacgtggaaagaggctcaattttctagatgggtggcaacagccatgatcttctgtcctctgggtccccacaagcctggatgaactcaagatctgactcagtggcacagtgaggagacctttgaggcctcagtgaccatccttggacttcacctctcacggctttcaggcagagaggccctcccatgcccacaacaggctgagcccagccttcctcggggtttgcttccaggcctgacttttactcccctttctaagtgaggcagccatgactggccacttcatgtgctcctggagaagggcttgcaccagccgttttcaggaaagtcaagcagctgttgactcctgagtctgggtgaatttgtgtgaagagcataaggcgctgtttcttaaccaaaacgcttcctcttgcagtgcagatgggatgtgcttctccacaggaggccccacggcttccccacccctcagaggagcgccgtgcgtgcgtctgtgtggaggattggcagctcctgcagtcggcccttggtcctatttggcgacgcctctgccttccccttaattatacagtcatgagccgccctggaatcacggcagctccggatggatcctggatgccagaatgcagcctcagcacggggctgcaggacaggagtgagcgaggggctgcagagccggcggccgcggtgggcaccatggagggggctgccctgggcagcacgggcatgagtctcaaggcccaggtttgagtaacaggtgttgagagcttacttacttttcctgagacacagtttcctcatctcgagagcacggaaaatcattctaacttcagaggattgttgtgaaagttaaatgagattaaagaggtaaagcccatgacgtgcttagctcgtgcttggctcttggtcaatgccagttagcgctgcattttctcccctctccctccctccttctctctttcttttcttctattctccattcctgttttctcccccaccccactccccaaagctctgcgttgagaaccagatgctgtctggtgggttagggccagaggaggaaaagctgcccgccgtgggctgcacccataccctcttcattccaatgacatgaggggaggggaaaggacagaggtagactgtcctcccctacctcctcctaatacaaatggaattcctggaactggaaaacaaagaatacccccataaaaataagacagtacttctggtgcggtgtaataaaggggaaagtaaccctcaatgtcaggaaactccgcacctcccagctcatatttgtgtggaggaaaagttaaatattaatttggactcaactgaatgtggacacaaacaatgg

SEQ ID NO: 28 - DNA, 3679 bp, Homo sapiens
gaggcagccatgactggccacttcatgtgctcctggagaagggcttgcaccagccgttttcaggaaagtcaagcagctgttgactcctgagtctgggtgaatttgtgtgaagagcataaggcgctgtttcttaaccaaaacgcttcctcttgcagtgcagatgggatgtgcttctccacaggaggccccacggcttccccacccctcagaggagcgccgtgcgtgcgtctgtgtggaggattggcagctcctgcagtcggcccttggtcctatttggcgacgcctctgccttccccttaattatacagtcatgagccgccctggaatcacggcagctccggatggatcctggatgccagaatgcagcctcagcacggggctgcaggacaggagtgagcgaggggctgcagagccggcggccgcggtgggcaccatggagggggctgccctgggcagcacgggcatgagtctcaaggcccaggtttgagtaacaggtgttgagagcttacttacttttcctgagacacagtttcctcatctcgagagcacggaaaatcattctaacttcagaggattgttgtgaaagttaaatgagattaaagaggtaaagcccatgacgtgcttagctcgtgcttggctcttggtcaatgccagttagcgctgcattttctcccctctccctccctccttctctctttcttttcttctattctccattcctgttttctcccccaccccactccccaaagctctgcgttgagaaccagatgctgtctggtgggttagggccagaggaggaaaagctgcccgccgtgggctgcacccataccctcttcattccaatgacatgaggggaggggaaaggacagaggtagactgtcctcccctacctcctcctaatacaaatggaattcctggaactggaaaacaaagaatacccccataaaaataagacagtacttctggtgcggtgtaataaaggggaaagtaaccctcaatgtcaggaaactccgcacctcccagctcatatttgtgtggaggaaaagttaaatattaatttggactcaactgaatgtggacacaaacaatggtcaccaagtcccggaacaggttgtgtgagcctcttcaggggttcatccagcgctgttttggagaaatctctatttcaatttattcctatacgttagttactgaaaaacaacagacaatcgcaaaagcaagttgcccgttttgtgttccttgagcccaatcatgaagtgccgtcgtgactgggcctcatgacaaacaacttgtaacaagtaacaacagagctcaggtcccagaccgcactgaagctctgtgagacctctcctcatctgtgcatgaacgagtgtctgactctggagcccagcctgctgcttcccagtctggtggtgaatcctccgtagtctgatggaggtttgctcttgttgcccaggctggagtgcaatggcacaatctcggctcactgcagcccctgcctcccaggctcaagcaattcttacgcctcagcctcctgagtagatggaactacagggcatggactggaactcccaatacccctgacatgggctgagtcaacgtggtcatgaacatgtgacaggaggcagcagaagttgcagagaagagtgaggcacgtttgaaaaaggctgaaaaatgtttctgtccaggcaagggtgtgtgctgaatgactcaaggattttttggagagaattggagtgtctcaccagaggagaccacgtctgaagggctttgcatccctccttggacatgtctaatacctaacactcagaaagcatccagtaaatattcgtggaaagaaaggagtggagaaggggagaaaggggaaagggagtaggcgagagagaagaaagactctgcttcttgcccagggcctggcatggggcggaggcaaagcagtggggtcctcagctatgtcccactgtgagtgcacagcgagtcctgaccttcagagggtgcagcccgaggggccctggcctgtctgaagggtgcgccagccgagtggcctgctctgaccaccaggctcacccatgactacctgggtggctacagccagttcctgacaatgagtacagcactcagttatcggggcccttccacccacacgctgtccacttcctggggtactgctgtgggcatgtgagtgcttgctccccggggcactgctgtgggcatgcgagtgcttgctccccggggcactgctgtccacttcctggggtactgctgtgggcatgcgagtgcttgctccccggggcactgctgtggacatgtgatagcttgctccccagctccactagtgacactggcggcccctcgctggggccttccccgcctgctccgctccattaccgctgccgggctcctcacgtctctccttgctgcttcctgcactggggtgaggagagtggggctggtccccttgagaccggagaagctccaggcttttaaggaaaactgccagggacgaagagaagatatcacttccccacgtggttggcttccagattcagaaggaatgtctgtccttgtggattccgtaccagatgaccccagatgctgcctcagtactaggtccctgtggctctggagcctttgctgggtctgggcagtgtctcttcctctccagttcatccttgggtctcttcacccttgccaggggcaggcttcctggtgagaggtcgacctcctgcatgaaggctctcaagaggccagttcaaagccaagctccgggtctgtgcctgtggggctgctcctcgatcaggagatggtcactcccctcctggtctgtatctgtgggattctcctccatcaggagatggtctctcccctcctggtctatacccgtgggattctcctccatcaggagatggtcactccccatcctggtctatacccgtgggattctcctccattagatggtcactcccctcctggtctattcccgtggggctgctcctccatcaggaggtggtcactccccctcctggtctatacccgtggggctgctcctccatcaggagatagtcactccccctcctggtctatacccgtgggattctcctccatctggagatggtcactcccctcctggtctatacccatgggattctcctccatctggagatggtcactcccctcctggtctatacccatgggattctcctccatctggagatagtcactcccctcctggtctatacccgtggggttctcctcaatcaggaggtggtcactcccctcctggtctatacccgtgggattctcctccatcaggagatggtcactctccctcctggtctatacccgtggggctgctcctccatcaggagatggtcactcccctcctggtctatacctgtgggattctcctccctcagaagatggtcactccccctcctggtctatacccatgggattctcctccctcagaagatggtcactccccctcctggtctatacccgtggggctgctcctccatcaggagatggtcactctccctctcggttgctcagtccaaaaacaacctctctggaaaactgcgtggaatttttttttaaagaattgaaactagaactagcatttgatccagccatctgcctactgggaatacacccaaagaaaaataaatcattatatcag

SEQ ID NO: 29 - DNA, 4435 bp, Homo sapiens
caaatgcctggcagcgtcctcggtgcttcacctgccatagccgacagtggctgacctcccatgcctgttgccttttctttctgttggatcagggatacactgccatgtgtgttaagaaaagctggccttacctacagggctggccagtcccggtcacgtttctagtaagccattgccttacataagggtaacggcatgggacgctatcttagccaatgtgataaaagtggacatgaggtgagaggcttcagagagaggttttaaaaaagagacaaaagcaggacgttgcctctcttcctcctctccacgtgtcctacccggatgtgaagccaaaacagatgcaggcttagtgcaaccatggggaacccagcataagcacagattcaacagcagaagagtggcagagggagaaggtgaaaggaacctaggttttcctgtccttgttgagtcattcagttaaaaatccctggaattttcctctctccggcagtgtgttttgtgggataatgagttgccttattggggttggcttgctagtcgggatgtttcgctcccatcaacatccatacgcttgctctgtgaaccaatgacctgatgaggtagtattagcaccaccatcattatgctgaggatgagatttatggcacagtggttcagtagcttgcccaaggccatgcggctggtaggttctggaggagggctcagggcaccccctgagctacccctgctggccattgcaccaccccataaagctgctggcagtcacttctctgaggggttagcatgtaagaaatgtcctcctgaatgctggccagacaaatggaaatctgccagggttgggtacccccatgacagcagccagcctgccctcttagtccctgacagctgcagtgacagcatctgtgattgcaaagcgtgacaatttatatctctcatttcatcacaccatctatcagcagacagtcaggctttaaaaatcaatcccacactgactcagtccccagcagagatggcctctgacaacagtatccacactgcaggctggacaagggccctattaattttgagactcagccaaatttccttctgaccctaagctggtgaatccctgctcctttgctttggttggggttggtgtgagctaaggctgtgatcccatttgctcctatggcctccaggtggcctgggcctccatgaatgggccacatggtcatactgaatgcttgattacactcagacctagcagtcgtctgggcgcagctggtttatggatcactttgtcacaatgttccatccttccaggtccccatccccgcggtgggaaaacattgctttaggcagtgctagaggacttcagcaggcattggcagcttctggattcaggattagaacaaagaaggaggagtcacagcaaagataggaacagaaggcagagagaacagacagatgggggtgtttgagaaggagggcctttgagacctcagggagtgggagacactggctcgagaataataataatggcaatttctctcatctgtgttttcagggcatggactggaactcccaatacccctgacatgggctgagtcaacgtggtcatgaacatgtgacaggaggcagcagaagttgcagagaagagtgaggcacgtttgaaaaaggctgaaaaatgtttctgtccaggcaagggtgtgtgctgaatgactcaaggattttttggtgcattgaatgaacagcgggacattggacacctgctgatccatcaccccgggcccgggcaggcccgtggatgaagagagatggagaagaccaggcatgagactgtggagaagccacaccaccagaaacccctgccccatgcgccgtccagcccacacctgtggatgcacgggggattgcaggcagggctcccaccgtggactcaggaacaggcagggaagctgctgcctcaccaggcgaaggggccaggagggggaggcggagaggcccgtctagcccctgcggctgtcaccgtggtgcctcctcactggccagtgcggtcgcgcctcagcttcgttaataggggagggggcctaagagttttcacgtccaggctcgggcagtggggaggcaggcaggagtggccgctggtttttcagacctcccagggaggccgaggaaatggcccgtcctggagtgggcgtggttctgtcttcagatggatgctggagggttgggctgcgtgggaccctgggccctgctgcttcccggaggatgcgctgtccggggctgcacaggttggctgtgttttttggatgcttgatattttgttttttcttctcttcactctgtcatgaaactggcaatagtagtttgtaaataaatatgtgttatagatgaatatttgctatgagtaaattaataaaggagtgaataaatgagcgattgatgtagggcctgtcctgtctcagggagccccacgaaggcctgcgcgccggccagagcctgcctgcctgccagggtactgggacgtcactctcaaagcggcgggacccagccgctgatcttgctgaggaggcccggtctcagaaaactgagcggctgcttctgcagaccctgcatcctcccctccctggagaaagaagctctggctgagtcctgggaccgaacccttgggtgccacagaaacgggctttgctgcctgtcagtcaagcggcgggagaaacagacctggggaggaggaggctgggagggctgtgttttctgcacagcgagtagctccttagcctggtgccatttctctccaaacaccctgaaggttgagtccagggtgaagatgtagaggcaagttttggggggatggagtgggcttggagggatgctggcgccttagcaggctgtgctcctgaggtgcccagtgtctgcgggcacaggaacatgttgccgagggcatttgggtgtgggtggggtggggaaagggagacagggctgtctcttttaatgggtatctgcgagcatgtgattgtaagagaggaagaagtaggggaggaagaaggcctccttgggaggtgcgtcatcctgaggaaggctgaacaatgagggtcttggagagtcaattcagaagcacaaccttgcagagcaggcaaaaacaatagggcttcttgaggctgcccgggcactcatgcaatcaccatttcctgctgtgaatgagcctacattttgttggggaagagacgcaacgacgccaaacgatggactctgagtcaacgataagatgaaacaaaattaaaacaaagtaggaaatcaagagtggctgctgtgatggcgttgcggagatgatgtttgctttgagaactggacaagtgagcccctgagctgcatctgcacccagaggctgagccggtgcacaggacttgcagagggatgggcctgggcttgtagagcagcacaacggccccaggcctggaggagcaagggtgggaaggggggcaggccagctcctgccaggctggagaaggactcggacctcaggccacctgtgcctgggtgattgtgaacttgtaacaaatgtgatcttatttatgttttgaaaaaggcaacacaaaccaacacgagccgtgtgaggatcaggtgacagctgcccaaaagctgacacaaggaacaagcctggaggagtgaggatgggtgctgtgaaggaggttgtgcagctgggcccgcagtcggacctggtgagatcagaggagggggtgccaccagtctgtggacgaagatgagaagctggaatagagcagaaaacaggaggctgccactctccatctttcccaaagtcactccaggagcaagggtgtcatttactgaaatgacagactctccatttcacatttttcccccaagtgcagagtgcagggaagcagatgggctaaatttttagagtcagggttattaatgtatactttacatagtaaactttccccttttaagtgtgcaggcctgaggtttgccaaatatgtgtaggcatttaatcaccaccacgatcaagatgtagaatattcccactatcaaaaagtttgctgtgtcccttgatggtcatgccccattccacagccccagccccagcccctggagattgctgtctgctttatgttccagtggttttatcttttccagactgtatggatgtgaatggaatcagatgtgattccaaggtgttttatcttttccagatgtgaatggaatcagatgtacgaaatcctatggtagggggtcttctgagtctagctccttttgtttagcgtgatgcatttgaaattaatccatgtctcaggcatcaggagttcatttctttttctgctgagtagtatttcattgtatggatgtactgcaatttgcctatccattcacctgttgatgtacatttgagatttttggcaattatgaataaagctgctataaacagaca

SEQ ID NO: 30 - DNA, 4996 bp, Homo sapiens
aagatgggacaattttttttcctcttggtttctttataattattgtaccccttttctggaataatcttttcatcttgttcatctgtcaatgcctgcttgtcttctcagatttcaactcaggtatattatcttctcctgagttatttttttaactgctgtaaaggcgtatttctgtgccccatatctacgcttcctaggataaagcacgttcctctaatagtgtacaacatttggcaattgcctgtttgtctcttctctctgctagacgttgtgctacttgagaatatagctttcccttttattaatttatttcgtttacatccttctgtcacaggattctaccagcctggatcctatgcctgccaagggcaagtggagctggaagggatgtgtgagcaagcaagcatcaggtccggccactgcacatagctgctggctgcagtggggtgggcagctccagtctccagcacaagagccagctccttgcgaggctacagctggaccagacatcccacaagcagcttccacagatggcactagggaatgcagtggcacccagaagcttgaaggcaccaggaaccacagagccccaaagagggtgtcacagtcctggcttggggaactcctagatctgggctccctgaaggactgcagctcttctctccttcttgtcacccacaacatggtgagcaaggggtgtgtttcagccctgtttgtgttacaaagggcatgttcagccctgccatttggtgggtcctgagttcttgtccagtgcccaggaaaaatgaggaatgctgacaagtggagggttagcaaggcgaagaggagctttattgagcaatagaacagctcagaggagacttgaagtgggtagcatttgtccacagccagggtgtcccgatgagtgttcagctctcagcagagaggagaccctggagtgggcagctcctcttcacagctggtagtgtcgatgtttgctcagctctcaacagagaggggaacctggtgtgggtagctcctctccacagctggttgtcttattgtctcctcagctctcagcagagaggagaccctgggttgggtaggttctctctgcaactggccatcctgctgtcttcctaagtctgtctgagtccaggacctttatgggcctcagaggggagaaagcgtgcaccgattgattcatgggcagctatgggcaggcatggaaaaagcaccacaagttcccgctacagtctgcaggactagcagcctggcccccaggcttcaggccctccctggcttgaagatggagcttcagtggggatctgcccgcttctgcccaggagcctgtctgcctcctgctgccattcatggcactcaggctgttcatgccaaggggttcctgaaggtcagcaatgacccgccctcagccctgcccttggccttcctcttgtgctagttgtgcccaaagtccggaggggatgaaggtggcacggggttggtgtgtcaatacttccctgattgtgcgcacacctggccaggctgggatagtgaccagactcggccccaaccttgctctgagatcaaagcagatgctaggagtggagagaagccaaacagtgggagcaggcacttccaagcctgtgggggtatgggggtccttcccaggcccctgagagtgcagagatgcctgggtccacagccgtgacatgaggagttgcagctgtgcctgggaaggtggggctcctcctgcctgttcctggctctcaccagctccctggagcgtgcagtgctgcctgtgcctccacactgcagctggcatcgtggcagctgccgctctatacaggctgccactgccatcacttccagaatattacgttgctgctacctagtagatgttcagtaagcttcttaattttaataagcatttaactaggaacatgaagttctttatactttgagacattatatacctgcttgttattgccatgagtgctttctgtctcttgactgaaacatggctcccaagcctgaaacatcagggataaagtctggtgaggaaaacaaaagcagagaagagaaccaagagccagcatggttcaccaaggtcacagggctcttggttactgactgaatccagactgtagtccaatgctactagcaacaaatctgttctttacactgagtctcggctactttgcttctctttaaatgcaagtaatcaaactttttcttcctactactaaacattttagcacaggtattatttatatacttattgaatgcacagcttttcagtaacaatcctagatagctagtgtcactatttaacaccttaaatctctaattatgatgagtccattttgacctttcctagagttcctcagaggcatccctattattgtcttatcattaagatttattagtatcatttcatttacgaactgccattttcattttattttggggcatatgttcaaactggcatcttccccagctgcaatcaatgtacataatgccacagctccttgattggtttaagaacattttcttctctacggataggaacacagtttaaggtttctgatgatggcacatttcaagtgatgctgcttaattcacctgcagttctcagtgtcttggttgtctcatattcatctttaaaaataaacttcctgatgttgcaaactaagaagtggtcctaaagaaaagaagattaaaaccacagatggtgcaatatagataccagacatcctattacactaactctgagtattacaattaatgtaatgaagaaaaacttaaatgtgttggccttaagaagttagataagacccagtaggtgacaaagttgcttacggtgatggttgatttcctattccaggttgttggtttttcttttttactgttctgaactagaaaaaaaatgtcttggaagttcatataaataactttcatgatttctaagaacaatcattggttacagatgaatgttttcaggataattgtcatatagatttggttatgagaaattaataaaaattgttccaaataaatttaatgtaatatacatcatttatatgaagtctttatcaacttctaaaatattgcttttaagtgtttttatttatattaaaatatatagtctatcttcactggaaatattttcctaattttgttttcatataattgcttttattattgtaatttctgttgaacatttatttagtactcattgatcaagtccatacaacaaagaaaagtttctctaaatctccaatgaatttggctgtgctctgattattcctgcttccctagctttcaagacaaacaaaactgtctaaaagttttaattgtagttgataaattctgaaaatggagtaacttttaaaggctctttcacacaaaaatcctaaagaaaactcataaataattactctcagtaaaccccctcaaatttttagagcttttttcactttattcccttgatataaagtgttagtttttaggtggattaaaacaacctattagaaaatcttgccaggtgtgttggcttacccctgtaatcccagcactttgggaggctgaggcgagcagatcacctgaagtaaggagttcgagaccagcttggccaacatagtgaaaccctgtctctactaaaaatacaaaaactagccagacatggtagtaggtgcctgtaatgccagctacttaggaggttgaggcaagagaattgcttgaacctgagaggcgggggttgcagtgagccaagatggtggcactacactccagcctggatgacagagcaagactctcaaaaaaaaaaaaaaaaaaaagaaaagaaaagaaaatataatagactgactctacatttatttgtactgttctatttaaaaatattttaaataatttttaacagactttgcaccacagaatgtccaggatatatcaggaaggagcaatgaggtaagtgttcctcaaagtgacagttataagtgactaagacatagggagatgaatcacttggtcatcatattgatctgaattctgggaggacatagatcataaatttgaaggagaaaggcaatgcatttctgcaaatggatactgcttaaagtccctaacatgctccttgaaataaatggggcacaaaagaggttgttttaccctaaagcaattttacctccaatcttggcagatttccaaatttttgagacttgaccatagtcttatgttagagtggctttaaggggacaggcaatgggatattcactggatgtaaaatcagatgattttggtttgaaagcaagccttttcacttatcaacttcttgactttcagcaaatcatataacatctcaaattattaattgtcatattatctgtgaatgacatatatatacatatataagccaagagtgttttgtaagcagtgaatttctttactgccatattcaataaagcaagcagttgttaggtgatagtcattcatttattcattcaaccacactgttatgttgggtggaggatactgacatccatgaaaaacaatcccctaatttcaagacatgtatagtccagaaagggttgtagactcaactcattgtggctcacagatgtattttgtctgctggcatatttatttaaagttggaattgtaaggccttttaataccctctccagttagtcacatgctcaacctctccttttcttatattaacctgctttagtcaaacaaggtcacacactataggtactctctttagtcaaattattttttccagtggatatgccttatttatgttgcagtttgacactaaagctacattcaagaaaatgtttctccatgcaagctgttggaataacatccataagaattcagccattcttatttgtatatttgtccaaaatgctccttttcccccattttacttctagattatgtatatctgtaaatgtttcttagatttactttgctacattatagttttgccaaaacatacccctgccaaaca

SEQ ID NO: 31 - DNA, 3938 bp, Homo sapiens
agctgctggcccccctgggtccagaggagccttgccgccctcacctgcgcagagcctggagccgacgcgtcacccccagcggaagcgcctcgctgcccgggcgtctggcgaggtgtgcgctccgggtcccagctccagcgcttcgcggcagtcgcccgcctctttccgcaagcagggcggggactgggcggcatctaccgagatctgcgattcgaggcgccgaggagccgaagaccacagctcagctcagacggcgccctagggccgcacagagggtcgggcagtgccggagagaggtttgaaagcgccgccgccaactcgacagcgcgtcccagcgccttgagctcgcttcctcctgctctcaggaaaaactgaggaaacgcgcctggttccaggggtcggcggggaccgtggagacgctgccagcatcctcaacagcttggaaatcccatcaccttggttccctgagacttggaggactagtaggaactgacagctggctgacagaaaacttatccagggagagaagagacaaaagtgaagtgtgaaattttgaataatgttttcagatgctttgcattcagaatagacctctgagttgggacccaagctgtcaactgatcccaaattcctaagttcctgacttgcaggtattgagttctaacctccgaagatggatgaaggtatggaaatttcaagtgaaggaaattccttgatcaaagcagtccatcagagccggcttcgcctcacaagacttttgctagaaggcggtgcctacattaatgagagcaacgaccgtggggaaacccctttaatgatcgcttgtaagaccaaacatgtcgatcaccagagtgtcagtaaagccaaaatggtgaaatacctgttagagaacaatgccgatcccaacatacaggacaaatctgggaaaacggctctgatgcatgcttgcttagaaaaagctggccctgaagttgtttccttgctcctcaagagtggggctgacctcagcttgcaagaccattctagttactcagctcttgtttatgctataaattcagaagatacagagaccctgaaagttcttcttagtgcttgcaaggcaaaagggaaagaggtcatcatcatcacaacagcaaagttgccctgtgggaagcatactactaaacaatacttaaatatgcctcctgtggatatagatgggtgtcattccccagctacctgcaccactccttcagaaatagacatcaaaactgcctcatcgccactttcacattcttctgaaacggaactgacgctttttggctttaaagatcttgagcttgctggaagcaatgatgatacctgggacccaggttcccctgtgaggaaacctgcattggcccctaaggggcccaagctcccccacgctccaccctgggtcaagagtcccccattattaatgcaccagaacagagtggcttcattgcaagaggagctccaggatattacaccagaggaagaactatcctataaaaccaatgggctggcactttccaagcggttcatcactaggcaccaaagcattgatgtaaaagacactgcacatttgctaagagcctttgatcaggccagctcaaggaagatgtcatatgatgaaataaattgtcaatcttatctttcagaaggaaatcagcaatgcattgaagtccctgttgaccaggacccagattctaaccagacaatatttgcttccaccttaagaagtatagttcaaaaaagaaacttgggggcaaatcactacagctctgattcccagctctcagctggccttacccctccaacttcagaagacggcaaagcacttataggaaagaaaaagatcctctcaccatctccttcccaattgtcagagtccaaagaattgttggagaatatccccccaggtcccctgagcaggagaaatcatgcagttttagaaaggcgaggttcaggagctttccctttagatcacagtgttacccaaaccagacaagggtttctcccacccttaaatgtaaattctcaccctcccatctcagatatcaatgtcaacaacaagatttgcagccttctttcttgtggtcaaaaagtgcttatgccaacagttccgattttccctaaagaattcaaaagtaagaaaatgttgttaaggagacaatcattgcaaactgaacaaattaagcaattagtaaacttctaggagatgggtataaaacacatcttcttcaaatgtttatatcagagaaacaaagaactagagaagaaatcttaaatgttcattcttttaaatctcgtgattggttagtccataatggctagatggattaaaatgtaatgtgatttgtactaggcgtcatgagcataaaaaataatacatagtttctgttaagggaattctctcaaacaaaaggaaagcgatttttctcaatgcttctaatatttaacaatctccatgtagtccaaatttgtcattaaaaaaaaatcaaagaaagaaggccacgtatgttggggtaatttttaaaaattttcagattggctaaatattttattaggaaacagttttcaagtcaataatttttttaacatttcatgttaataaatgagattgaaattttttatgatctctaaaccataaaagaaaacaccgacagctgtaaaatgttctaagataaaaaaactcgagctacaaagaaagaatgaactaattctttacaaatgttgactgaagatagataaaactctaattaaaaatttaaaaggttaaacactgtattagaatgggcaactaaaatattcgtggtgtcagtttaattagtgtcaaactggcaagtcagagttttacaacctactagtaatctatgccgggtcttgttgtttgtgcactgtgttttgctttgctttgttttggtttttaaacagacttacctgtaaagttatcttacggaattattctttctccatatcttttaaggaattattctttctccatatcatcttttaattcctgttattagttttggaagcttatccataagtttccaaagacaagatgatataaaagttaaaaagcattcctctttacttatatcaaattattcttgtctttcaaaaagaaccaaaaaaaaaaaattcatcatggataaaaactaagcgcttgccttcttttaaaaagaaaaactgatgattagattaggttagctaaaattaatagaggcagtagaaacttaatcacaaaatgtactaaatatttggcaatattaaacaatgcctttttatttctgatatgtagttattagacatttatatattaaggataacttccttagtgtgacattccaatcatttagtattttaggacctgtgaataacttccaacaaaattaatgaataccatattagtattataaaatattataaagtaataattatatcatctatataacttcaaagtatgatgtttatacaaagaatccttatttcagtctagcagcttaacaacaaaggataaatcagactatacaaaacctaagtgtattaatttgatgattgtcacgtacaactttctttgccttccaagtagaggtgatcctaacaattggcatgatgcttttcttggtaatttgatataagcaagttgtaatgtacatagtaattatttaattactgtggcttttattttaaaaagtaattagaggtttttccatttcatgtcttgaacaacattaatattaattacactagaaatattttttgattcagaacttagaattgtacctgatatttataggtatttaaatgctttctgcaagttaaatatcgagaaaagtacttgacttcaagttgtaaggatacaatttggaagggtatgtaaatagattagttcataaacaaaatggtatcaataaagattttaaatatca

SEQ ID NO: 32 - DNA, 542 bp, Homo sapiens
agctcagctcagacggcgccctagggccgcacagagggtcgggcagtgccggagagaggtttgaaagcgccgccgccaactcgacagcgcgtcccaggaaaaactgaggaaacgcgcctggttccaggggtcggcggggaccgtggagacgctgccagcatcctcaacagcttggaaatcccatcaccttggttccctgagacttggaggactagtaggaactgacagctggctgacagaaaacttatccagggagagaagagacaaaagtgaagtgtgaaattttgaataatgttttcaggcacggccgtcgccagcatagtaccggctcctcttcttctcccagaacctcctgacaccaaccttggtgaaagaaaagctgtgacaatgctttgcattcagaatagacctctgagttgggacccaagctgtcaactgatcccaaattcctaagttcctgacttgcaggtattgagttctaacctccgaagatggatgaaggtatggaaatttcaagtgaaggaaattccttgatcaaagca

SEQ ID NO: 33 - DNA, 12351 bp, Homo sapiens
aaacaggaaaagaaattgggatttttatgaaaaatgttaaaggctagctctgttaggatttcccatgacattgcagtggtgacatggtcgtggatgtgccaaggaaagcctgagctgttgactgctgccccagtagcatcagagaaccactgtgcttgctgagaccaatgactgccattctggacagggcagcctttggcaacattcagaagcaagctgtttgtcttcagtcccctctcttcagcctccaaatttgtcattattgcttggtggatggagtaccctatactaccccatggctctccaaaacccttttcctcccagccaggaggcccaggtctgcgcattcactcactcgattctgtgcatgttgcctgtgtgcggtccattgccctcacctcactttcctggggaaagaaaaaatgacactgagctgaggaatgagcaaaaatctaggtagagacgtgggagaggctgtgctagttggagggcgtgaacaaaatcgtggaagtttacaactgtctgacttttctagggaaaggcaagtaatctgatgtgactagagaaaggttaggtgagatctgtaagctggtttgggtgtagaaggacaaagaattggagtgggaagggtaagtggcagctagactgggaagggctgagcaccaggtaaaaaagacaaaataaaattgtttctcctctcccaggaaatactgaactttaggaggcaacatctccatcctggctctgtaaaccaatctttatcagaatgagaattttggggtaagttggaagggacagggccaggcttacagcagcggttggcaaactatggtctgtgagccaaatccaactgctgcctgtttttgtgtggcctgtgactaagaatgatgcttacatttttaaatggttgagtaaaagtgaaaagaaaaataatattttgtgacttgcaaaactgtacaaaatccaaatttcactattcacacataagttttcttggagcacagccacatacacttgtgatgatttcactgctttggtcatacaagggtagaactagaactgaattgttgtgacagagatcctctgtcccgaaagggcctaaagcatttcctgtctggctctgcttagaaaaatattgccaagttctgtgctgggcacggtggctcacgcctgtaatcccagcactttgggaggctgagatgggcacatcacctgaggccaggagttcgagaccagcctggccaacatggtgaaaccccatctttactaaaaaaatacaaaaattagctgggcatgatagcgggcacctgtaatcccagctacttgggaggctgaggcaggaggatcacttgaacccgggaggcagaggttgaagtgagccgagattgtgccactgcactccagcctgggcaacagagcaagactctgtctcaaaaacaaaaaacaaaacaaacaaaacaaaacaaaacaaaaaacaaaggagtcgagcactagacagaaagttcagagcaggatggagctctacaaagataacctaagttttatggagctgagttcccaaatcactttaactaaatgtattaattccagtggccatgatttccctagcacttattctcctgtagcataattggaaattctaacaagcctttttttgcggggaggggggagggtggaggttgtttgtttttagtgtgagatgtggattaagcatattaaaaattttaaaataatttctgggaaatttggaaaactgtgttgacagggtggttgccatgcattttaaggaacattcacatggttgaagagtcatagagaaaacattgtctttcagaatcactcatccaaatcaatataaataaattgctaagaccttttctaaccttttaaacattcatctttcttcatgagaacagcaataaatgtcctttgtttctggagtctgccaatcacctatttcttctttagtgtgggtaatttaaaaaattgttttcataaggctaaaagacattatgttatacaatgtctctatttttttttttaatggcaaggcagacttcattcaagggtggcacattgtggtaggtataggaaccattgcaatgagtgttgcagcaggggagggagattggagtcaactcactactgtgtctttacaattttattttttctttcagagacagggacttgctctgttgcctaggctggagtacagtggcgtaatcatggttcattgcagcctcgaaatcctgggctcaagcaattctctgacctcagcctcccaaggagctaagaatatctttaagtttttttaaaaagcaatccttacttcctgaatgcaccaaaattgtaatcccattttgacccagttaagaggaaaactcaaaactgagagggcctggttaaagaaaagtgagtagaggatataatacaatgattgacaggaaaccctggtgtgttgtgagacacagcagtggagttgttaagagtcgcctcccagttgatgtatgctatctcagaatatccagatttcccagctgacatcttctgcctcccctggggtggtgtgcaaatggagactgtatcagtcagggttcagttgcagcaaagggaagcaactctagttattttaagcagaaatgtttaatacaaagaattagctgcatggaagtgctggtggaagagatggtttttgggagactcccaggacacttgagagcttaccacctaggggaacaactacctcttccatgaaggtggggagtcagaaagttgctataggatcaggaatctgccattttttcctcacagatgcatcttgactcccatgaagctgggaattacaagtaccctgctggaatgctgctgcagaaatatatctgcactaccatattttctagtgaaattcagccaaaagcagcaggaaaattatctctgcctcacttccactttccaaaccttgcacaagtgcatccaagtggggataagtaggtgatcagaaccctagctgcaagagattccaggaaatgtagtttttttatttctagactctctatgtggggagacacactggaagggagtgaaagagaatgttgaggttaatcacctgtatttgcttcctattgctgctggaataaattggaacaaactcagtggcttaaaacaatacacatttgttatctttcatttctggaggtcagaagtctgatggaggttttacaaggctaaaatcaaagtgtcagccaaggtgtgctccttttggaggctctaggggagaatccatccatcccctgcctttcccagcattagaagactttcccacattccttgctcatggccacattgctctgacttccgcttctgtcatcacatcaccttctatgactctaaccttcacatctccgtcttataaggactcttgtgattacactgggttcatctgataatacaggataatctcacctctcatgattcttgacttaatcacatctgcgattcccatcttccatgcaagaaacacattcacagggattgatatgttgacatcttttggggggtcactattcagcctgccacattgttcatatccaaattattgagggaaggagctgatgtttattaactacatgctatgtgctggaaactttatatatatatatattatctcatcaaacattcatgacaatccttgaaggtggcactattactcctactacaaatgagaaaaagagattcaaagaattttaaatacgagtccactattcagcgataaaaaaaatgaactattaagccatgaaaagacatacaggaaccttaaatacatattgctaagtgaaagaagccagtctgaataggatacgtactgtatgattctaactatgtgacattctgggaaaggtaaaattatagagtttataaaaatatcagtggtttccaggggttaaggtttggggcagggcgttgagggtaagtaggcagagctacattaccctacttatgagcaatgagttctccccccaaaaaatcatttttctatcaaccaggctggagtgcagtggcatgatcttggctcactgcagcctctgcctcctgggctcaagtgatcctcctgcctctgcctcccaaatagctgagaccagaggcatgtgccaccacatccagctaattttttatttttggtagacttggagtcttgttatgttgtctaggctggtctccaactcctgggctcaagtaatccaccagccttggcctcccaaagtgctgggattacaggtgtaagccactgtatcaggcccaaatttttgatatcataaacaacctgtggcaaatattcttgcatatgcatcttttcacacttctttgactattttttgctaatacattcctaagggtaggttttctgagtcagatggcaggcacattgtaaacaccttttatatatatatatttagaaagtgtcagtggtgtgctggaactctgaaacaaattagagctttccccctcttctatggagagctgactattaaacatttagcatactactggaaagtgtgtacaaatctccagtcctaacagtatatgaggacccattattttcacctcaaaatccatactgatgcttaaaacagtaatatgtgctagttgtaatttgtatattctaatactgatgattcatagtacctgttgctatctctagtttttcttttctatagctcatttagaggttaaaagaaatttcaggtatatttgggcatatttcatactcagccaggtcagtatggtccattaagggcaagcaaattttgcagggatttagcataattatgcaataattccaaggagtctctgcactttggaaaattgttatttataaaaaccttttaactaattgttttggcatacattgttgatctgcagggaacttggtgacacacagagagggaaggggagagagtgattagaatctccaggagtcctttatctaattttccatcatcataccatatactccatttaagcccacgggtggggatcttcctgaccttgttggtactgctaccctggtagctagtaaaccactcttttaatgtggttgtgttgcttctgttgcagtggaataaagatttggaccactgagtcatctagttctaagaagctgtgattctatcagaaatgatcaatggggggagtcagctggcataatgaaaatagcatgaatttgggggttaaggtctccagaattctaagtcctgctttgccacagggctatgcattttctgtcattttctactccacagcttgattggcttatctagccaactagattcctgcttcattttccctaatcactcctggtagatcttttcgccaaggatttacaaaggagctactcaagaaattcccatgtgaaagagtgatagtcttctacttgataaaagcataggaatagcccctttgcctctagataactgaatgctcttagacaagcctcagttttcacatgaatagaatgagtacatgtgtgttagtctattctggcattgtaataaagaactactgagactgggtaattgaaaagaggtttaattggctcacggttccacaggtggtataggaagcatagctggagagggctcgggtaacttacaatcgtggtggaaggtgaagggaaagttggcacatccttcatggctggaccaggaggatgtgtgtgtggggtgctacacacttttagataaccagatctcatgagaactcactcactgtcatgagaacagcaaggggaagtgtgcccccaagaatcaatcaggccccaaccctgacgattacaattcgacatgagatttgggtggggacgcaaatccaaaccatatcagtgtgtgtgtgtgcgcgcatgcgcgcgcacgtttagaggccggggggaactgcactcaatgtgtgagtcctgaagttcaatgattctatgaaaccaattcacctgtatagtaaatgtggtggaatcacactagtgccttcaatagaaactaaactcccttaaaagaagcgtttgagttagcttccagagactgctatgtgagaacatgatgttaagttgtcatatgtatgctataatttgattctcactggaagaatgcagcagtgatgtaagaggctgtttgtgaaattaggccatcagggaatgcttgtgccccatgactgtaaggactataattctcttacacacagacatcaaatgttattgcaaagccattggaaaaattctaattattttaaaggcatatataaaatatgtaccttttattaaataatatgaatataaagtaagatcaagttctgactctgagctgtccatgctgatgacctacagagcattgccagctttagtctctgcattgccttcttttcttgtaagtatcaatggcagttgcccactcaatgtaagttgaagggtgcagctgaaatcaccaccgcatccccaaaatatcttttccaccaatgcttttgaaaccaaaggtttgccacttgagatgaagaaatcctttttctaggtttttacctctagcacccccttgttaagaatattgcaatgtcaattggtcattactaaaggccagagatagccaatgcaatcaccaagtgtatcagcgtatcaattttttttttttttgagatggagtctcgctctgtcgctcaggctggagtgcagtggcgccatctcggctcactgaaagctcctcctcccaggttcacaccattctcctgcctcagcctctcaagtagctgggattacaggcacccaccaccacgccagttaatttttttttgtatttttagtagagacagggtttcaccgtgttagccaggatggtctcgatcttgtgatctgtctgcctcggcctcccaaagtgctgggattacaggcgtgagccactgcatctggccttttttttttttttttgagactgagtctcactctgttgcccaagctagagtgcagtggcaggtatgagcttggctcactgcaagcaacctctgcctcccagattcaagtgattttcgtgcctcagcctccctagtagctgagattacaggcaccagccacaacacctaatttttgtagttttagtacagacgggttttcaccatgttgaccaggctggtcttgaactcccgacctcaagtgatccacgcaccttggacttccaaagtgctgggattacaggtgtgacccactatggccaactagttttctgggtcttctgtaaaaaaaaattaccatgaacttggaggcttcaaacaatttaaaaaatgctgttatagttttggaggccagaagtccaaaactaaggtgtcaacagggttggttccttgtggatgctctgagggcaatccattccttgcctatctcctagcttccaatggctgctgccaatcctcagtgttgcttggcttgtagacgtattgattcagtctctgtctccatcttcacatctcattttcctctctatccccgtgtctccagtttctttctgccttgctcttatgactcctggcattagattaaaggtccaccccaaatctaggataaactcatctcgagatttttacatctgcaaagatgtaaaagaattctttgcgaagaagcaaagaattatatctgcaaagatctttttcaaaataagtttacattcacaggttccaaaggtgaggacatggacatatcttttttttttttttttgtcagggtccaggggcactgttcaatccactgtagcatgggaagccctgataaaaagagacacaggacaagtaagtactgaacggaagggatggtaaaaagagagatttgaaaggtaggatgagaacactaggctggaattgggggatgggttggagattgaaggataaattctttctttctttttttttttttttttgtttgttttgttttagttttttgaaacagggtctcactctctcacccaggcaggagtgcaatggcgtgatctcagctcactgcaacctctgccttgtagattcaagcaattctcgtgcctcagcttcccaagtagctgggattacaggcatgtgccaccatgcccagctcatttttttgtatttttagaagagatggggtttcaccatcttgaggtcaggtttcaaactcctgacctcaaagtgatctgcctgctttggcctcccaaagtgctgggactataggcatgagccaccacacctggcctggagaaattatttccattttactgatgagcattctaaaagggaaattgataatcttgaagaactttgcctggggggttctccttgcaagggattctttggcctgagaaatcactggcccttatgctgttggtgccataagagaatctgggaatgtgactaggaccgaaccattttgtgcgtgtttttttggctgtttattcacttgtctattcatccatccattcagtaaacatttattgagcactttctttgttcctggaacatagaaggctacctccttctcaggtgccttgttgggatgttctgtccctgtttgtatccagcgttgggctggcagtttagtggagttgcacatggtcaagtcagccactaagattacaatcaagtagagtcaaaattgccttagaaaacttctgaaaacatctataaagtacacctaaatgggtttctccaatctgaatacggggttcagacacaataaacaatcgcaggatggagataattgaggaacacgatgaagcacatcctaggatgataattggttttgtcttctaacattattttaattcttcttttcttccctttgccgcacttacagaattaaagttgtgaaaattatatacgtacttcacgtgattctagtctactgccacacaaggctctggtggagatgtagcaactggaatctttcaaaaccgtgtgagccagaggcagccatagggatattatggttgcttgtttattcagaagtcactgttgtgtggttgaaagagacatgggctactcctctctgcttgaaacagaaaattccgtgagagactcacgcaacctacaagaggctgggttgcctcatggttcatctcaatgatgtcctcataaaggaaactccagtcaggtagccctcaaagcattgaaaacaatgtaatttttcctgaaatctcatgaagctgcaccgaagaggaaacccatacatagcatattttcttaaaattccgtctcacatttcttttttaatatttcacacatcacagatggcagttacctaaaattcccactttttatcccttaacattttgcaaatcctccccaaattttttgcactctggctcttctttctccctgtcctctggttttcctgatctcaattttatccccttttacatgtaaatcagtctagatggctgtagtattttttcattttcttgaccactgtttccttcttatgagatccataaagcgcaaagcaaatctacaccgaaaactctggaattaaccaggatttgaattgagcagtttgattttgctacttagtaacaatgtgattttgggtaaatttcttaaactctctgattctctctctttttttctaatttgtaaaataaagccaataataccaaattggtagagatggtttgaggattaagtgaaacaatatattttcagattcctatcacaatgctggccatattaggcggtttaaaaaaatgctggtcgttttctttttcttttctttgtagaaagatctccttgtagagacaaatcacaatcaaagactttttggttaatgtggaacgagatcatgtgaattagagcacatggcgctctaaaggctccatgctaagaataactgacagatccatgctacggcaaaaattgttttgcaatgggaactacggctaggggtctgcctcccatcaaggatttatttatggaggaattcccaaaatacaggaagaatgttcaaatagtagcagccaggaaatttccaacatctgctacactgggtcactctgaattggtctttttggcttctttctgtaatttccattttgggaaatcaggagttgtgactcacagtggtaaatcttcacacagttgaaatatgccttattagcacaatctattttagtattattaatgccatagtataaatatgtacagcattagaagtagtcaattagtggaggctgatttttattttacttctatgttggctttactttcaaaatatatgttatgttattattgttttccttttcttcattttcattgctacctttcttggtccaagccatcactatctcttaggtaggtgatgagatagagcactaagaggtctgggactcttccgcccctacacagcagccttgccctccacatggcagctggagtgatctttataaaaccacacatgagaacatgttcctcctctgatggcttcacaccacatctggaataaaaccctaacatcctaccctgaccgagtgggccctatgagttccccttgcctctctgagcacatctactcccccgctcatgctgggtcggccttctatccgtacctttgaccatgtattccctctgctttgatctcttcccatctattcttacagggctggcttcttcttgccattcaggtctcaatatctcctcagacagactcctagccccttaatctaacgtagacctgcttctactccaatcattatcgttctgctttatctttgtagtgtgtgctactctctgacattttgaattatttgttttcttgcttattgtctgtgtaggggagaaaagatttctttcctcactcattgtaaagttcatggccaacaaccctatgacaaaagagtaataagcaaaaagcttgcaaatgcatttcatgtaaatcttacatgacatgtgagccttcagaagcaaagccccaaagacccagggaaaactgtatttttatggacagccatacagaagtataattgaaggacaaaagggtctgatccaaaggtaacaaactgggagaaatgtagtaagacctgtttgttcagtttcttctgtgtgggcacctgccacatgagtgtcttcaggggagaaggaacagaagaggtcggagagtgacgatcctgggttttatggtctgcttcaggggaggaaagcctgagagaaggtcagagacgccttcctacttctgctgttttttcagtttccaaggtgtcagtcatattttggggtatcacacctgaagcctctgcgagaccacaggtctgtgtgcctgtccagtgtctgggacataacaggagcttaaaaagcattctctccacacggggatttaccgtagacatgtttgtgaaaaccaaacaaatccttaattcctctccccctgcaaggtgtccttcctccatttagagctgcccttttccagagttcccagggtctctgggtcattaccaggttcccttatcacaaagagaaagagtggaagtttcctatgttttctctcctcaacctccagtcagttttctccattccaggctgcctttgctgtgtgcaaagctcaattgtctgcctcaattttaataattcagtgttgaatgggcacatttgcatatgcaaatatttgaagaattgaaatggcaattaacagatgtatatttgggattaatttaaaatattttttgtcttttcctgtttactttcatggtccagcagtaattctgatcttagtgacttgctgtgattcctccatccaatgtgtttccaggtctactctagccagagtcagatttctaaaagatgctgtgctgtctttgaatacgattgaaaaatcaccattttaacccctttatagaacctaataaagcatttcagaagtacctgcatttctttttatttctacctggttgatgagcctctctctttcaaggcttcagctagaggagaattgatcaacacgtgttattataattatttgaggacctaccatggaaagggcactgtgctggaagcagctgggggaatatagagaggagtaagaccaaagccctgtcctctggagccttatggttccacaggaaggagaagatgtgaagactcgttacctgaagttgacatttggtggatgacacagcattcaacacaaaacatttgccatcccccaaaaagctgccaactgttactggatggctttggtgatttccatgacatttttccaaaatacaatgactttcctcttgtggtttttgtacatcaacaaatcttttcaactaacaactactgggaaaagtgaatctatagaagtttattattaaataaactaacatgaaaatg

SEQ ID NO: 34 - DNA, 31532 bp, Homo sapiens
tccctcccttccttccttccttccttcctttcttcccttcagtttctcttccttctaatgccccctgtccttaaaaatgtctccattcaggcactatgcaatttgttaactccacttctcaaagataaatttctggtcagagtgttctattcttgctgttttcattttcccacctcctatttactcttgaatccacaggaatctaggttctactcccaacaatttgcaaaagcttctttttctaaaatcacaaatggtactgctcctaattaggaaatccagtagacagttttgagttcttatcttattgttctcttacacattgtttgaacttctgaattatttcctccattgtagacctctctgtttcttcagagttcaaagcttcacattctccttacagctcactacccactctccttctgtttcctacatggcctctgcctgtgtcaaaaatgtgaaagaatagagctgtgctacttccatagaaacatgagggagtatattcataaattctgcaagacatgtacgcatacaaaattaaacaacaacaagaggaatgtgctcaagagaacacatgacaggaactgtggttcagaagaagagcagatggagagtgtgggtaagagtcgttctgtaagcatcatgttgatataggatgagtgtggcattggggctgcaaatgccactgcagtgggatcccagcactgacagccatagggccttgggcaagttacttcggcacaatgaacactctatgggaatagtaatagttatgtcctgggactgttgagaaaattaaacaaaatccttaagccattatttgcagtagtacctagtatgtgcttcatgaatatatgctcattttcataaagaaagggagtcttgagaacacttttttctcctctctcctgcatccaagcctgaagaggcagaaggaactccaggagttgaatggaagagcacagaagggaaacagtgagcatcgttactactgcaccctcatcccagctatgatctgctaatcctcagatagcctgagacggggtacggaaagtgttagatgaccagcaggttagacaagacctttgaccaatgtcagaaaggtgcctggaaaaggtgtgggacctggctgagatttcatctgggtacagagaataatttaaaaagcttgctggaaggcagtggtatgatgaaaccatgcaattcttgtttaattttacctatatcaggtctgtcttgttcaataaatgagttatatgtacttacaaatcattaacaggtagtactatcaaaccatacttaaaatatttctgagttttcaattatttccttttctagataaagaaatagcgacagaggcaccccagtggatgtccctgcacacctccactttggggactattctaagagcaggagcccaatgggggctgcaaatgccactggagggcaggtgatccatgaccagtgaagacagaaaaagaggagaatgtggtagtgatggaggttgatattgctgtggtagaacatgtggaaggaaaatgaagataggcaaaaattgaggctcttcagattcattccatgtaggggaagagggggcaaaagtaagagcattgttcaagaacaaccaggtagaaacaaaaggaacagagaatgtgttgacctccaagggaagaaaggaaagcaaagacatttgtgttacagtccaaagaggacagtccagagtaacaaggatggagtatttgagtatccccaagaggcttacaaaaaggaactttacttatagataagcaatgatagggtaaaattgaaaagaactaaagagaaagaaactaagacagttgacaccctggagaaaaagtttatgagcccctactacagtcatgcattctcaaaataactgctaaacaaattagccatctcagtaaagcaagactgggtaagaatttaagaatctctccatcctgggttggcaagtgatgggcagaataattgaccagacatcctccagctcagttcctgggatgcagagatgctggtggaagcactttgtagcacagcaaggtgagagtttgaaggggcttcactttctgaaaaatctctcttcataatcctgtttttccatttcagaaagaatttaaatcaaaaaccttaatgttcttgtcatctctgaacacatgctgaatgcaggggaaacaccctgaagtaggaatttctgatctccctcttcctttgttgtcattcaagaataccaactcagcttttacaatttgatgtccttctaacttgaggaaaccatgccattacgaacactccccttgccttagaagaagatatgtgagttgggtcttagggagactaaggaaagaaaactctccttactggggacaaacagtatcctagaacactggattctctatcagtagcttctgaccccaggggtgtcacacagagctttggacttaggaaaagtcacatagcatctttgagcatggagtcccaattggtaattatgatgtatgttgctgcctgatggttcaggatatttccttgaaagacttctttccatagcgctctgattatgctgtttgggattaacagaataggcatagcggtttagataggaaattttaaaaatgacaaattaaagaatcctggaaaatacactgtacattctgccaaggtttatcaatatggatgctggtatagtaatgagaataaatcggtaaattcttttcataaaatgaaggaaagaaattactatgtgctctttaaaatgtgttgcatcagtgcctgatttgattgtaagggtcacatcttcaagacatgtgataccaccctttataccacattatagcattgtctaatgttgtaaagtttataaattgctttcactcagtcttcatctgattctcagaatgaccctatccaattgggaatatgggtttcattagtcttacattactaaggagattcagagagtctcaattggccaacatcatgcagttaaaaatgacaaatggggattttgaacccaagtcttcctgaccccagaacccgtgatctttgtactacatcatgcttcctgagaaattaaatggacctgtcttgcagaactgttcttcttctaactagggatctggaggagtctcaagtaaataggcagatggccttagggagggatgtctggaagcacctgtttggagtcccagcaggttggtggttttctgtctgtaggtctggcagctgggcatggtaacttagccatggaaaggggctgcaagaggaggtcctcagtgctcagacccagggcagaggactgtgtggctcctgtttgtttctccagatctactctctacacgccttcaccctgctctctgtttgggatggaatcaaaggacccctttgccccctggcttatggttgccttttgccaatggaagcagtgacagaggatcagattagaggtagaaggggagtgaggaaggagagtgaagagggataaattctccttctgcctctgatcctctgtcgctgcttccactgccacctactgcttccattggcaaaaggaaggatgccgtgaggttgccatgagcatgctgcagccttccagtctcctataagacagcttccccatggggtccttttcctattcctcctcttgccccttctgacctagccccaggtacagtactgtattacttaccttctcttataccttttccatacctttgtcgatggtctccttgttggactcctcacattacccagtttgagtgtgctttctatttcctgatgggctcctggctgatcagacctgaccccagaggacctgggtaccagaatctaatgcctggattaaggcacatgagcaagacgcagaccctgcaaatggaattgaaattacaatgacctagaacaagggagatagggccaagcatgccctagtgaacgagggacccaaatggggtaggactgggaagaaatctgacttgagactgatgggctaggactctgctagaagggcccttctggtcttccaggagacaagactattcacagacgctgcaaattggtggtgcaaggaaggcagcaggagctcaatagggtacagagtctaaggagagctggaggcatgaaccaagcagagtggctgggtgtttgaatccttgcttctagtggcagagactgaccggctattcatcgaacccatttttatttcctcctgggcacatggactatggtcctcgtgttcttgagttctagccaatggaatgtgggcagaagggatgtgctagcccttaaaccttccttactctctcccacctcttgccagctgtaaggaagagtcacagtaacatctattatttacttattcattctttcattcatttatttcattcactccctgaaacaagagccaagggtacagcctctctaggaggtgactctcatgcccttttattatgctggcttgatactaatggagatgcggttgaccattgcaaaaacccctgttgagacacagcagagttggccagcattcttatggtacttcggatgtggatcctgtgatggctacagcataaaacactgcattagcctccatcttctatcctttttcccttcaaaaatgatgatcatttcattgagtgcccaccctgcaccaggtgcttctgatactttatgaaatatgatgttttaaatatgaaaatgggggcttacataatgctgtgactaatttgagccttgctcagcagttaggcagcttcaatcttcttattaatatacagggagtggttgctgataataggcacattttcaagcccaaaggcatcttgacagtgcatgctgaggattgggggaaataggaaacctccaaggaatactcctgatatctttgcatctgtatacacatatgagttgtcttagtgtttttaccatagaagatccttaaaagttgacacaggcaggctctgggtatgtgcatcgagagatatttcccagagtctgtttttttgacatcctttcaccatcattttatctcttagcaggaatcagttgcccaacaactcctgtgatcatctgcaaacctctttacagttttcagtgtctcaaggtaatacataaagaaggaagaaacaaaagagtatgagtatcactattcatggatactaattaccaaatgtacttttttgaattaaatccttgtttgaatggaggttgcacagagatgaatgttttgttagcagacttctcgaggccatggcaggtttaaataattttgcgccacgggagacaaattttcctgatgttggaatcctaatgtgggtgaaccatgtgaaatgctgctttcagcaaggagctgacttcccaggctcccttttctgagggagttgggcagagttggggtggtgacagtatggtggaggcagaagcttctatgtcctgattcccttgtactagaaatttcattacagatacttgtgcacatcagatgcattgttggatcagagtgtcgcatgttcgttccttcacagatgttatttcagattaagccacagacagcggggagtggacgtggcatgcattttcctcttcatttggtagcgtctcatctcccagcagtcatttgcagagcaacattacttgcataacaattgagccgatctgatattttaggttatgatgtcaagatatattatactgcagcctactgactttataaaaaagtagccaaagaaagaaaatgattagggccgagttgggattgaaagggacctgagggaatgtcatatgttatgagaatcttaaaagcttctaatgacctgttattccccaagggcgcttgctactgtgacgattgaatttattttgtactaaacaagctttgcatttaatgccatctttttttatggtctgagacccacaagaatgtgttttactattttctgaataaaatacttggtcaacagtttatcatgcaatcatctttctttatgcttccatgactatatttagtaatactatattttgtattattaaatgtatttatgaattcttctgttataatacttttctgtttaaggatgtttgacagtgtatatcttaaaggccaagtgtcatctttgcttttgtaaatatattttatagtcttaaactgaagatgttgtttgtgagcattttcatggcatagaatgtatgcacaaagcttaggattaaagtaagccttttaaaaacagcaaccgtgattatcaccaaatcacagtgtttttagggtaacatggactatggtcctcgtgtgcttcatatgaataatcccacctcccttctacctggtaagctctatgacagaagatgctgtacataacaggtattcaataaatatttgttggatggatagatggattaatggatgaatggatggaggaagtagatatgtgtgtgatttggggttgagggccgtgctttttctgtgagtccagacttaagtcaggctgttttgcatcactgagcttcacaaacatttactggaagtcaatgtcctgctgttcatgtgaagaaacaaaagtgcagagggctaatgaactcttaggaggatggcactgctttccattaagcaaagccagcgtatttttggcttagaaaatgagttcaaatttgaaattgctttctccaaaatggttgcagtctttcaaattacagaactctcctggaaattggagaataaataaaaatgcaaggatccttgctttggtgagtaagctcacaaggatggaaataggcacaaaaagtggcagtgtctctgaattatcactgagtgtgagtttctaagagaacaaatcactttcacgcagccttgacaatcacttggttagctcaaccccaggaaaggctatgaacagggctgggaagcagaaataatgcattattttgttgagcttattaacatttgggcagaaaggatagattccttttacatagttaggcatcattttaacatgtacattataggtggtggcttttttgtaacagaaataagtgtagctatcccttaacaggagcaatttcccttcatatttcttgcagctcttgtcccatgaggcgacagatgagtatgtgatagcaatactgattccagtgctgagatgccatctgatccactgggagagctggtggattcaaatcaatgtcagctcatgccttctgggcagcagtctttcagtgcaggatttactctatggatcagaaaaacagctggtgacttgcaatatattatacaaaagacctttaaaatgttttgttgtttccagctatgatgtagtgtgagtcacttcaattttttttatttgtgtgcctttctgatggaacaaaattccgttaagcaactggtaaaaacataatagtaatttaaactggtgtctgtagaatattgagactgaagagtgattagaaataaggttttactttaatgtgcatttttagtgtaaaaattttacccatggaaagcatttattggaaatcctctcctgagattccctgtaaaatataagcatatgccaaagccaataatccttgtgggttacttggaattattggaaaagaataatttttaccgagttattttgctaagttgtgggttacagttatttgtttccagggtatattgtttgtacatgacagaattttggactttcttctttcctttaggtcaagttttttccccataaaagatgtataataattcatattaacattaaaacatttattttgggaggaaatactcaatgcttttagtcccagaactagtcttctttccctcactgagtcatttttggtttttatactttggtttttcatgggtttttttaaatgaggtttctttctcactttaaaaaaaaaagtattttctgtctctgtagtccaagtttctggtaacaattaggatcactagtacagaaatacaatgtatgtctagaaaaaggtacaaaaataaactagcaagattcttggatggtctggatacctaaaagacaagggatttgaaattttctgagtgtttggtgagtccagttagtggctatttggtatcaagtgggtatcccaaatctgatgtgattagccaaatttccacaccaatcatccagagccaatgccagaatgacgacctcgcatacatcaattcaatggctatggtttcccagttgctttctgtagttctctgttgaatactttaatgaaataactaaatagacgccagccatcttgggcatctctgtggatgaagagctatgtgaaatactatcatactcaatatttgtagggggtgagtcttaagtctgtggtcctgtcaaggagttcctcactacatttgactgcaagcataattagcaattggtgttcagtgtgcaaggaactttgattgattgggctgtgttttaggccttgtcaacatgaacaaaacatatcatcaggttcgtccatcttgcttagctacttttatatgtacttgaatattccagcaatactaatttccactgatcaattaaggaagcaatcctaaaggaagatgagattaaaagaaggaaaaagaatcacaaaccaaaagagcatttcctgaagtgtgtccaagaacactaattattggagaagttattaagatttgggttggggggaggtgggtaacccagtgaaataagtttgagaaatgctgagataagccaagttagcatttttttcctatattttagggctcatcagagcttttaacatgccatgaacattataaatctcaaaaagggagacctagcttccccaacttaatggaacacctcctctacatcccaccatctgatttttttccccaaagaatattttgaaaaacaaccttttgggatgtttgcttaatacatgtggacttaaaattaaataataattataaataattaaattcagttgtgttcttggcatcataaatttatttgacttatcatttattgaaagcctgctatgtgccagacactgagctaagtacttttacatatattaaaattgtaatagccccatgaagtaggtgctattttaccattttaatgaataaggcactgaagcttagagaagcctggtgattttcccaagtttgcagaagtaggaagtagtgaaggtagaatccaaacttaggccataactgataaccatgatactataacaaatagtctaaataaaataataaaaattgtgtgtttatgtctgtaagagaaagctggaccacagctttttagatccagagaaaggtggacctaaaaattttcaggaattattaaatccagttctcaatgtttagagacccagaacagtgatatcattttctaatgatacaccactaattgatgaacaggaaggagctggaaccatactctttttgactctttgatgataagatgccacgtcattcttgatggctttttaattagttgacttcagaaaacgaaacaagataatattgcttttaaaagtttagatctgttttgttagtagattataggaatttgctattaggttcattgtttcatgatgaaacattgcaaatgttcattggaaatgtttcataccaaaaaacagactataaataaaaggttatttaaaatatttaaaatcatgtgagtgtgaaggtgagtgagaaaatatagtgtccaggaaaagtaatgtcaaacaatagcatttgaataataaatgactcaaccgaagtagaatataggctttttttttcttgaggatcaaagcacaacctcagctttatttataggggtaatagtcatctctgtagtgtgaaatgaaatggggcactattatgttgctgcacagtctaaatttctactcttacatacattatattacattaaggcaatatgtttcagtagccatctgtttaaatgaaaataactctggagcagaaatacgtaaagcagtttctcaaatattaaacccagtctgagcttgggcttggcatatctctttttattggtgtcaggaaatataaaagataaattttgatgggaggaggctcatatggaaatggtcagaaaatgaaagaatgcctggggcaggcagtctaagtacaggcagcaatttatcccagaagaaaggaatgtaggaagtgaggtcacccagaggaaagatgatcctaggagatgctggatggtgctaaagacagtattcaatatcgtaactttcaacgatataatccaatcttagggattgcctctttaccatagagaaacatatatttacaagcctctcagcttttgtaaattgttacactttttttaaatggttgggtaaaggaaagtctggaggaatctaactctagcactgtccttgagcagctctcatcaagtataacagctgctgtgtatgtaagagaagtgggggatgactgggaaagttgttccagtgtgatctcctgaaatagatagaagacttgcaatttcacaccaagatccacagcctggccttgttttctagttgcagatctgaagtagtagtagtccatctgtcagcctgacatctttttatgctccctttcaatcactcccagaggaaaaaaaatattttagattgattctgattttggtaactttcttattacctatcagtttaaaaacattaaaagatagtagcagatttcattttctctcatcctgcaggtttttaaagttggaattttacccattctatttgggtcctaggaatagtgatataactgacagacagctgactaataaatgaactggagaacaactattctatttgtctttacataaattctttaaaaaatgatagaattggtttattcattcactaaacagacatgaaccaagcgcataacagaacactggaaagttaaattcctatgagggagatgtcattctgggctgaacaaggctgtgcaagaagaaaagggaccaagaatctgactaagaatgaagatgatgatgggcaccctttgtggatgcaaagatcagtagaataggtgtcttgcaccagatagattcaagtggaaagagtgatgggtgattcaggaaaatcctcaagggccaggagactaattaaggtcaagtcctgtggagagcaaaatccaggagatgtatcatcatttgccatatgaggaagtggggatttgctacctcagatcccaaaaaaagaaactctttgctttccatctcactttgttttgtctattgtgttaggatgatccttatacatgaaaaagctcaaaaactgactcaagattccaggttttggaagagagccattcatgcaatgccaaagtacacatcaaaatgtgcaacagagagtgtggagtgacaccatcaactaaagaactagtcaaagttcctacgagcatggcgccatacagccaatcttccttcttggttctcagtgtcttcgagggtagctcaaagggtcactgtcacagtgaccatgaattgtacaggaatcctgtagacagtgagaagatcaagccttaagaaacaccacatttatctatttggaggtagagtactgtttgttttggtttgatttggtttttatttgatttggaggttttggctataaaagagtgtcattttgtgattcagaaatactcactctttaaaatgttagtttcatttttagcgtcctcacattcttttggttccttttattggaatcccatcttataacctaatcctattaatatttatagggtccacatgaatatgaaattaactagtaggttccatttatgaaaagggatcaactattaagtcctatattttgttctttaactttggaatttgattcatgatatcttgtaaagctttgaagtcaactgacagtatgacagatttacaaacatctgtttgaatttggaggcctttccatctcttctgattgaaagtaattatactcctcttctgcacctgttgcattgttttatgttgtcatatactcgttgagtgcatgtacacgtatctgtcacgtcacttagattgaaagcttcttccagccagaaatttgtgtcatttgtctttggatcctcagtggtaatcagagtctggcatatagtttatgttcagtgtatttctaaggagggtagatttaaggagggtagagatgacatcatcatagtaataaataagagtaacttttcttaaagactggatttctatacttgggaaatggatattactttgaaggggagaagagagtgagagcaagagtgagaaaagaagaaaatgaatggagttcatgagtacctaggagttgtttggctagaataaaacaagtgtttcattacaggaaatgaagataatataaagagcagcttaaacttttttttagtggactaagttgagaatcctgtggagtgtagagttttcatgtctgggtagtcatgcctttcttatagttatggagggttaggtatgaacggggaacatttaaccatctgaattgaccatattaaccgaaaatggcagtaaagtaaccataaatgccagggaagtaaccatgcctacctaggacacatcagtgataagaaaatgcttctttcaactttttaacagatttattgaactgtaatctacataccataaagttcacctttttaaagtgtacaattcaaaggtttttagaatattcgcaaagttgcatacctgtcactgtaacctaattttagaacaatttcatcatcctctccccaaaataatcactgcccattctcccctcacttagtcccaaatcctaggtaatgactaacctacttttctctgtacatttgcctattccagacatgtcatataaatggggtcatataatatgtgatattttgtgactggcttctttctctttgcataatgtctttgagtttcatctgtgtcatagcatgtatcagtactgcatttctttttgttgtcaaaaaattccattgtgtggatatgtcacattttgtttaataagttgatgaacatttggattttttcaatttttggctattataaccactttgttgaaatcaataaaccacaaatgtatgggcttatttctggactcttaattgtattctattgatttatatgcctatccttatgtcagtatcacagagtcttaattactgtagttttataataagttttaaagtttggaagtgtgagtgcttcatctttgttctttttcaagattattttggctatttgggttccttgcatttctatacaaatcttaggatcaggttattattttatgcaaaaaaaggcagtcagtatttttataaggattgcattgaatctgtagaggaatttagagcatattgccatctttgtaatgtcaagtgttccagaggagtaatgtcagcaaaatggaggaatataggagctttctaccctcatctccctacagtgcaccaatttagacagccacccatgaaaaagattaactttgtgggagtctgagagtccagagaagcttcagcatgttcttggaccaaaaatctaagaagtgatgcactgaagaaggtaagaagaacagtttcattttacccacattactcctcccccaatttggcataggtcagtgacaagagagacccacgtggtccacaagtttctcccatgaagggaagtaaaaagcatagtgaatgagctcccggccttcccagctgtgcaggatgcactcaagaggcctatctctttcttgccccacccagaatactgaaaaaaaatcagcataactgagtagctgggggagcctgggagcagggaagagaggaagggattcacagcaactaaccaggaaactcaacaaagggccatgtaacctactaaccgtcttctcagattccatcaggtagtccacttaaaagccatttgggatgcctcaacagcacacccactccaaatgtccccatgaggacttccaatgtttgtcatggctcaccttcacacacactctgtgactggatccctgtgcatttccctctcatcccctccagtcttcctcccaatgcacagtgagtgtgagcctttgcagatggcttgggagcctgcacaatcagccagcttgcctctgcaagactgggagaaggcacataaacttgagcatttttttccctagggcatcaccctgaggaaaaaagcagaggcactgagcatccactgtgactcagtgagactgtgagaaggcatacaatcttaagatacgaaagagaagatgagagtgggttggatgcatccatagcaaaggtctgagactatgtacagtggttcatgcctgtaatctcggtattttggaaagccaaggcaggaggatcacttgagcccaagagtttgagaccagcctgagcaacctactgagaccctgtatctacaaaaaaatgttttttttaattaactgggtgtggtggtgtgtgtctatagttccagctactccagaggctgaggcatgaggattgcttgagcccaggaggtcaaggctgcagtgagccatgattacaccactgcactccagcctgggcaacagtgcaaggccttttcacaagaaagagagagacagagagaggaagaaagagagagaaacgaagaaagagagagacacagaaaggaaggaagaaagcgaaaaggaaggaagggagggagggatccagagaatacctagctgggctgactggccaagttatttctctccctaagccagtcagtaagaattagaggaagtgactgcttatttaaatgcaaagacagcagtacaaaacttcaaggaacatgaaaaactaaggaaacatgatatcatcaatggaacacaataaatttcccataactaaccccaaagaaaggaagatttatgaattgcttgacagtagtattcaaaaatcattgtttaaagaaggctcagtgagctataagagaagcacagacaactaaaaaaaaaaatcagaaaaagtacataagcaaaatgagaagctttgttttgttttgttttttcggagatagagtctcactctgtaacccaggctggaatgcagtagcatgatctcagctcactgcaacctcctcctcccaggttcaagcgattctcctgcctcagcctcccaagtagctgggattacaggtgcccaccaccacgcttggctaatttttgtatttttagtagagacagggtttcaccatgttggtcagactggtcgcaaactcctgacctcaagtgatccacccgccttggcctcccaaagtgctgggattacaggcatgagccaccacacccagccaagaagtttaacaaagaaacagaaataattaactaaacaaactcttggacacaatgaatgaaataaaaaatgcaatagagaggcaacaacagacttgatcaaacaaaagacagaatttgtggactcaaagacaggtcacttgaaattatgcagtcaaaggagaaaagaagaaaaaagaattgaacaaagaaagcttatgggatttacaagtcaccaccaaacaaaagaatatatgcattataggagtctccaaatgagaataaagagaggaaggaaaataagtttatttaaagaaatcatagctaaaatttttccaagtgcagtgaaatatggacatccagatacatgaggcccaaaggttcccaaacaggttcaagccaaaaaaaacttcaccaagacatattataatcaaatgtcaaaaagcaaagatgatggattttgaaagtagtatgaaaagagacctatcacatgcaaggagaccttcattagactgtcagaagatttcttagcagaaaccccagcagaccaggaaagagtgggatgatatagtcaaagtgctaaaagaaaaaaaaatgccaaccagaaatactttatctagcaaagctgtccttcagaaatgaaggaaaaataaacatttttccagacaaacaaaagctgaaggagttcatcaccactagacttgacttacaaaaaatgataaagggagttcttcaagctgaaatgagaagacactaattaataacatcattggtcaaggtaagtaagagtaagtaagtacagtcaaattcagaatactctaatactgtaatgatgatgtataaatcacttttagctctagtataacagttaaaatacaaaagtattaaaaataactatagctacaataatttgttaatggatacacaatataaaaagaagtaaagtctgacattaaaaacataaaatgagaaagtaaaagtggagagttgttgtatgcaattgaagttaagttgttataagcttaaaatacactttataactataatatgttatatgcaagccccatggtaaccacgaaacaaaaacctatagtagaccacaaaatataaagataatcaaaacatacagtatttttttaaaaaatcatcaaatcacaaaggaaaatagcaagagaagaagaaaggaatataagtaagaactacaaaacagtcagaaaaggattactaaaatgtcagtagtaagtcttttcatatcaataattactttaagtgtaaatgagctaaattctccatttgaaagacaaagaatggctaaatggatttttttttttaatctgctacctagaagagactcactctaacttcaagttacacctaggtttatgtgaaggaataggaaaagatactccatgcaaatggaaaccaaaagagaacagggtaactatactaatatcagacaaaaaagagcttaagtcaaaaattgaaacaagaaaccaagaaggtcgatatataataataaagggataatttcatcaagaggatataataagtttatatacatctaacatcagagcatctaaatataaaagcagttttaatgtatctgaagggagaaatagaaagcaatacaataatagtagaggacttcaataccccactttcaacaatgggaagatcatgcagtcaaaaaaattaataaggaaacattggacttcaactatactttagaccaaatggactgaacatacatatacagaacatttcatctaacagcatcagagtacacatgcatgtcaagcacacatagaacattctccaggatccttatatgtgtcttagcccttttgggctgctataacaaaatgccataaactaaatggcttttaaacaacagaaatgtatttctcacagttctggaggctgggaagttcaagataaaggtggcagaagatttactgtctagtgagggtccgcttattggctcatggacagctgtcctcactaatggaaggggcaagagcttcttatataaggacactaatcccattcatgagggctccacctcatgacctagtcacctccaaaaggccctggctcctaattatcatatcatatcataaaatgtattgattattacattttaacatgtgaaatgtagggaggcataaactttcagtttatagcaatatattagtctacaaaagaagccttaacaaactcaaaaatattgaaatcataacaattatctcttccaaccacaaaagtaagaaactagaaatcaataacaggaggaaaactggaaaattcacaaatataaggaaagtaaacaacatatttctgaacaaccaatgagtaaaagaagaaattgaaagaaaattttttaaaaattgaaccaaatgaaaatagaaacttaacataccaaaacttatgagatgaggcaaaagcagttctaaaagggaagattattgtaataaacacctacattaagcaaaaagaaagatctcaaataacaacctaactttaagaaaccagagaaagaagaacaaactaagcccaaagttagcagaaagaagaaaataacaaagattggagcagaaataaataaagactagaaaaacaatagaaaaggtcaagaaaactaacaattggtgttttgaaaaacagaattgacatgttttgaaaaacagaattgacaagccgttagctagactaagaaaaaaataagaaaagtctcaaatacataaagtaagaaaagaggagagattacaactgatatcacagaaatacaaaggataagagactactatgaacaactatatataagcaaattggataacctagaagaaatgaatgaattcctagatacatacatcctatcgagaatgaatcatgaagaaatagaaaatctgaaggtaccactaataaggaggttaaatcaccaatcaaaaatctctcaaaaaagaaaaagtgaggaccaggtggcttcactactgaattctttcaaacatttaaagaataagtaatagcaagtcttctcaaactcttcaaaaaaattgaggagaatgggaacacttccaaacgcattttacaaggtcagcattaccaaagacagacaagaacactacaaaaaaagaaaactgcaggccaatatccctgatgaacatggatgcaaaaatccttaacaaaataatagcaagccaaattcaacagtatatgaaagaatcatacaccataatcaattgaggtttgtccctgggatgcaagcatgattcaacatagacatgtcaataaatgtgatacacaacataagcagtgtgaagaataaaaatcgtatgtccatcttaatagtcacagaaaaatcatttgacaaaatttaacactctttcctgataaaaactctcaacaaactaggtataaaaaggaatagacctcaacataataaaggccatgtgtgttaaacccacagctaccatcatcctcaatggtgaaaagttgaaaccgtttcttctaacatcaggaacaagacgaggatagccactctcatgtctattcaacagagcactgaaagtcctagccagagcaattagataggaaagaaataaaaggcattcagattagaaatgaagaagtaaaattatctgtttgcagatgacatgatcttatatatagaaaaccctaaagatgccccaaaaaactgttagaactaacaaatcagggctaggccctggaaacataaggaggaagagaacactagtccctgctctctaggtgctcatggcctagtggggaaagcatggatccaaatgaaaatcacatcatgcaagaaatgccatcaatggcatgactaggtgtgataaaattactgttaagagagtgattggtctgactcagatagttagataacgtttgcattgatcagagtttagttcaatttttaagaatgtgagaaataggcatgggcatactgtaattggggaccagtctgttgccaaggcacaggcactatgggggtagggaagttggaaaggtggagaaagagtggcaagaaatgagtctaaaatgatagcttccggctagaatgccatcccaaggaatttggagccaatccagggggcaataaagagcattgcaggtctataaaccagaagactagtaagttcgtattttgttttagggaactgactctagcagccccatgtcggaaagattggaggaaagagatgaaaatgggagatggtgaaggcctgagttaagacaatggcagcagggctcatagaggagggggtaaaactgagacaatattgttgatgtagctgggatgaaaactgaaatgtgtcaaagatggagtcggaaattagaagataacatagtctgatgggaagaacagtacatgaagtctgcaaatctggactcaagttccagcttagctgttaactagctgcatgtccttaattaaatttttattttattttattttattttattttattttgattttgatttttttgagatggagtctcgctctgtcacccaggctggagtgcagtggcgcgatctcggtttgctacaaactctgcctcccaggttcaagtgattctcctgcctcagcctcccgagtagctgggactatagacacacaacaccacacctggctaatttttttgtatttttagtagaaacagggtttcatcgtgttggccaggctggttttgaactcctgacctcaggtgatccacctgccctcagcctcccaaagtgctgagattacaggctaattaagtatttaaccactctgttcctgtttcctcagctacagagagactgagtagattatctcacagattggcttccagaactaaaatacaaaactaaaaggaagaggaggaggagaaggaggagagaaattgagacaatttatgtagatatcatccaagataaagatgactaaagaaacagagcaattggaggattataatttaagagagttttgtttttaggagataaaatgtcttgtagaaaaagtttacataacacatttttaggtgttcaggatatccaaatcctggcacttgttcttcttacctacagggttctctgccaaagaacacctacaaaaggatcaataatcgaataagaaatccagtgtaaattttatcagtatctgaatagttccctgaaaatccaagggaaagctggatggcaggcataatttgggacaaagaaggaatggagtctcttatgtcccatccaaaatctagaccttgggatcctatgctcatgtgtgggagaaggtgtataggcacatacactctcatgttcagagagttggtgggtggagggagagggaaaaggtgagcccaaggacagcagagagaaagaaaaagaacctaaatatatgggcatgctcacctgtccaatatcaggctgaactgagcccagagatacccattatatttctgtgcaggattactgatcactaggggaaacatggccccataaataacagatttaatcagataagcagctcctctcccatgagaactagttcagaactaaagtaaagagctggctgtgagggattcatccaagaatccactgagccatgcaaggatggatgttttctcttatgagctgagatagaaagctgggaagagaagcgaagtgtctcatccttacccaacagtattattttgattcttcaatttttataatatgatatcctttgatggtgggaactatgtcttacccatcactgctcctagcttactgaactacagtgaatgttaattgaatcagtaaatatattaataatcaggattgactggatttaaataagattattgcaactcaaagaatcctcgggagggcatcatccatcttcaccatttgttatgaactcttcatgtgtattaattcatttaatgcaataacactataaggtgggaactatcatcattcccccattttacaaatgaagaagctggggtctggaggacccatctcgccccatcacacagttagcaagtggcagaacaggaatgggaagccagatattagatacagaatttatgcatttgcaaccacacacactgccagccaaaaacatgcttttcctctccaagagcacaaccgctagctttccttattggcttatgaaaactggaaacccagtttttaaaagactgtgaaaaaaaattaagccaatatgcttatcattttaaaaggtactctatttaattgaggatatatgttttcatacttttattcccaaatggttatcacttccttaattaaataatacatcaattatatttgtctataaatatgtatgtgtatatatacatgtgtgtgtgtgtgtgtgtgtgtaccaggccctcaataagtatttgctgaatgtttcttttctgcaaaatctatgtatactaatgtttgctaaattagtatacacagtctttctactgctgtttagagggaaggtgcgatgatttcccatgtttttaaaatcagatggttcaatatattcatgccacatttagagaagaaagcaattcacggtagagtatgaactctcaaagactttaagtctcaatgtaatttatcaactttatatatcaacaaacttttatttagtcctctctgtatataaaaagcttattagcgatcacatgctaaagcagatttttaaattgctagagccttaaaatgcccacaatatagtccagaaagaagacatgaataaaattggattatgtagcatagcatttaagggcttattcacactttatgccctccctcttctattcctacctattcttctagcacacagggtcaggtcctttccagctgcctgtctttcctcatgctacgctggcacacttggccaatgttggtgccatgaagaggttactcatgcagataggaagctgaggaggaggttttagaaagaagctgatgagttgagtgatggacacgttgagtttaggtgccaatgggaaagtacaagtaaatgtattgaagcacaattgaataataatgctttaacaatttgataattatgtgtggattaagggagagggaaagttttaagcctaggatattggaagaaggatgataaaaaagtaggaggtcagtgggaaagttgatttgcagagaaagatgctgatattagttttggatttgttgcacttcagaagatgatgagacattaaaactgatattgataatgtaatcttcacgatgaaaataaagtagagattgaggaactgatccagactgaaggagactagagagacccggaattgggtgcaacccaggatcctggagcagtgcttttgctatgaaggacgggattgagccaattggcaaaacttgattgcatctttgggcaaagggtatccaggttttttaaatcagatgattaaatagtatccattgtatgattcttataatttttctataagtttgaaatcatttaaaaataaaaagcagaaaaaaacaaacatcaccactttggcaacaaaaagttggcattgtcaatatatcttaagatctacattagatatgtaagatgtctgtatcttaatctagatgtgtgtgttcacaaactttaaactagtaattctactttgagacactatcataaagaactaataatttataggcatacttcattttattgtgcttcactttaccgtgcttagcagatattgagcgttttttttttttttttttttttttacaaattgatggtttgtggcaaccctgcattgggcaagtcttttggtaccatttttccaacagtatgtgctcacttcacgtctctgtcacattttgggaattcttccaatatttaaaactttttcattgtatctgtgatctatgatcagtgatctttgatgttactattgtaattgttttggggtaccacaaaccatgcccatataagacagcaaacttaatccatgaatgctgtgtgttctcctacttctccagtgactagtcattctcatgcctctctccctttctccaggcctcctttctccaggccttcttattccctgacacacaacaacattgaaattaggccaattaataaccctacaatggcctctaagtgttcaagtgaaagaaagagtagcatgtctctcactttaaatctgaaagctagagatgattaagtttagtgaggaaggcatctcaaaagccaagataggctaaaagctaggcctcttgtacccaacaacaaaattgtgaatgcaaaaggaagagtttttgaagaaagttaaaagtactactccagtgaacacacaaatgattaaaagtggatcagcctttttgtggatatagaagaagttttagttatctgggtagaagatcaaaccagccacaacattcccttaagccaaagcctaatccagagcaagaccttaactctctttagctctgtaaaggctgagagaggtaaggaagctgtagaagaacagtttgaggctaaaagaggttggttcatgaggtttaaggaaagaagccatcttcataacataaaaatgcaaggtgaagcagcaagtggtgatgtagaagctgcagcaagttctccagaaaatctagctaagatcattgatgaaggtggctatgcaaaacaacagatttaccctataattaaccaggcttcttcttcttcttcttctttttttttttttttttttttttttttttttttttttttttttttttgagaggcagtctccctctgtcgcccaggctggagtgcagtggcacaatctcagctcactgcaagccccatctcccgggttcacgccatttctcctgcctcagcctcccaagtagctggggctacaggtgcctgcaatgaaacaggcttctcttgggaaaagataccatgtaagacttgcatagctagagagaagaagtcaatgcctggcttcaaagcttcgaaggacaggctgcctgtcttgttaggggctaacgcagttggtgtcttgaagttgaagccaatgcccattgattattccaaaaatcctagaacctttcaggatgatgccaaatctactctgcctgtgctccacaaaaagaacaacaaagcctagatgacagcacatctgtttacagcatggcttactgaatattttaagcccactattgagaccatttctcagaaaaaaaaaaaaaatgattccttttaaaggttactccttattgacaatgcacctggtcacccaagagctctgatggagatgtacaaggagatgaatgttgttttcatgcctgctaacacaacatccattctacagcccatggatcgaggaataattttaactttcaagctctattatttaagaaatacattttgtaaggctaacctaccatagatagtaattcctctgatggatcagggcaaagtacattgaaaaccttctggaaaggatttatcattccagatgccattaagaacatttgtgatttatgaaagaaggtcaaaatatcaacattgacaggaatttggaagaagttgataccaaccctcctggatgactttgaggggtcaagacttcactggaggaagtaactgcagatgtggtggaaacagcaagagaactagaattagaagtggagtctaaagacaagactgagttgctgcaatctcacgatcgaacttgaatggataaattgtttcttatggaagagcaaagaaagtgttttttggttttgttttgtttttttaagacagtgtctcactctgtcacccaggctggagtgcaatggtgtgatcacaactcactgcagcctcaacttccccaggctcaggtgatccttccacctcagcctcctgagtaactggtacaggcacgtgccaccacacccagctaatttttgtatttttttgtagagacgggggtttcaccatgttgcccagtctggacgtgaactcctgggctcaagtgatcctcctgcctcagcctcccaaagtgctgggataacagctgtgagctaccatgcctggccagaaagtgttttcttgagatggaatctactcttggtgaagatgctgtgaacattgttgagatgacaacaaagtatttagaacattccataaacttagtttaaaagcaggagcaaggtttcagaagattgactccaatttcaagagaagttctatcgtgagtaaaatgctatcaaacagcatcagatgctacagagagatcttctgtgaaaggaagagtccatcaatgcagcaacttcattgctgtcttactttaagaaattgtcggccgggcgcagtggctcatgcctataatcccagcactttgggaggctgaggcgtatggatcacttgaagtcaggagttcaagactagcctggccaacatggtgaaacctcatctctacaaaaatagaaaaattagctgggcgtggtggcgcatgcctgtagtcccagctactcaggagaagaatcacttgagcccaggaggaggaggttgcagtgagccgagatcgcgccactgcactccagcctgggtgacagggactcatcgaagcaagatctccaccagctaaaagattgtgacttactgaaggcacagatgatcattggcatttttagcaataatgcattttcattaaggtctatatattgcttttttagatataatgctattgcacacttttagactatagtatagtgtaaacataactttttttttttttgagacagagtctagctctgtcacccaggctggagtgcagtggcatgatctcatatcactgcaacctccgcctcccaggttcaagtgattctcctgtctcagcctcctgagtcgctgggatcacaggtgcacaccaccacacctggctttttttttttttttttttttttttgtatttttagtagagatggggtttcaccacgttggtcaggctggtctcaaactgctgacctcaagtgatctgcccacctcggcctcccaaggtgctgggattataggcgtgagccaccacgcccagccttgctttcatgattttaaaggtattttaaatcaaaaggtcaagaagtgcacaaattcaggattaattatttgtatttaggattatttgccacagcgttgaccaaataatcatttgtggccaaagtttttgaagaatagactatagagagaggagatcagagtgggccaatagggagccatgcagtggcccacatttggaaaaggagaggaatgtgctgagcggagttgacggataattaactagaaatgactgcactgaaaagtgtgtgtctgctggtgttgctgaaaaaggttggagtgtgggtttatcacatcccgaaaaaggctaaggagaagaggaactgaagaaaaaacctaccgattcactaaggatttcccaccaagaggcctcaataaagacaaactggcttttataattcaattcaaacacaaattattttttaaattaattcctacggtttgcattgatattttaacatgagaagtggagttcagaaactgcaacaaaagggatttgagcagtgataaaatatttgtaagcctctcctgatgaccttggtactgaaagagactgttctcctgtgtcggggaaggttctggaccgcctttccagcagcattttatcatcagaaaacggctcacttcataaggtttataaccttccataaaactgcagaacattttattcttttttcattaagccacctttggaatcattttagtccctttatagtctcttatttaatctgttttttcgtagactaaagggagaaaaaattctatcagtggtcaaaatagtaattagatagtgtaagtcacagcctgatggcttcaaggcatacatacttactacttatctcctccatctgccttcatcagtgaattcttttactcccaagcacatctttacctttttcttaaacaatggaaaaaagaaactaccaaaccgtgcattttcccaattataagagttactaatgtttatattcttttctattaaagcatcattcccatggtgtaaaagctcttttaccaaaccctaaggaaagcatgaattaataaaacatcaagagattttatttcctatattgaaaactcctatagttgcataaaaacaactgaatcttttggaaatacgtgtaatcacaaggagaggaacattaaaagagagaaactcactacaaaataaatcttaaaaccactttcatgtttaaaaagaagaaaatatcagttcttcttattcctgaaggatttttttttaaaaaaatcttttaattaatgacagccctcagggcactgagcaattgttaattaaaacaaggagaaaaggaagaggaagtaggcaaaaatgctaagatgaacacgtttccttttctctgcaggggaataacattaccaaatgaacattaataaatatgaatactattgagaagaaatacatttaaaaaaattttaactcccacctcagcttgacacacactagcagctacataaattaattggggcgcctcgagaattataaacccctgggtgtcaccttttgtctaattgagtattggtagccatcaccctaccctcatcaggatggattgtttctttctcggtgcaagctgacttctgtcagggaatagcgcctgatcaaaggtcttctaagggatttcattcactttcattcactttcattcttgcagtgggcgggcattcacgtaggcaaccgccatcattataaaacatttcttaaatgcgagttaggagctagactcactgcccattcaattcattggtctttccctttgcagccattaaatttttacttagaaaaaaataattatcagatcttttcgttcaccccctgtgcttacctaatttgggcaggttattagtaataacattttcctggtcgttccctaccactttcccctctacctcacatgaaaaaggcttttatctttctcataagctcagaagttcacttaacaagcagagctttagaagccaagaacaagaaaaaaaaaaaaaaggtaagagaatctgttttctactttatttggagggggacagaaacccagaatcccataggctgtatgtttagcatgaaaaaaaaaagtcattatttgaaattaggacaaccagggatagtttttcccaacttttaaatgatcccagttttacgtaattttatgggcttttcatcaaagttgtttttcaaaaatagaactcaaccccttagggtttaagagttttttcccctttagtgtgcgtgcacacacccctttgatgttccgcatgctagcatatcagggtcagtgcatgggggccagtgtcatttacagaatttctcagatgccagctaagatcagtagctaggagacaacttagaatttcattttgctctttgttcagatacattctttaccacagataagatcttacctccccagcagtctatctctaaaagaacaaactctaggtaatcaaaaagctatattctaccccccaaccaaaaacaaattgcttattttagctaatacctagtcaaacataaatgccagggtagaaaaaataatgtattttctctttccttgctataataatatataccagttgaaaactcctgattttcctcagaccacctaaaaagctttgtccattgcttgtgctcatgtagtagctaaaggaggttatttacaaggcacaaaggagaaatacatagcccgtctatactgcatcacttttttgttctcttcacttgtgcatagtatctactaatgactagctgaggatagtaatttacataacattgaaatggaaaaattaaaggaacactttttgcttcgtttttcaaagtggacttacctaagaagcactaccatgctccttaaaaatgctttcttggttctccccactgatgtcgccaatctgggggtggggctcagaaatctattttttgtttttttagagcaaggcagggtcttgctctataacccaggctggagtgcaatgttgcaatcatgacttactgcagccttgaactcctggcctcaagcaatcctctcacctcagcctcccaaagtgctgggattacaggcacaggaatctattttttttaacaagcatgagagccattcataggccaaatttatttatttatttatttatttatttatttatttatttatttgagatagggtctcattctgttgcccaggctggaatgtagtggtacaatcacagctcactgcagcctcgacctcctgggctcaagtgatcctccaacctcagtctcccaagtaaccgggactacaggcatgcaccaccacacctggctaattttttattttttgtagagatgggatttcactatgttacccaggttggtctcaaactcctgggcttgagcgatcctgccacctttgcctcccaaagtgctgggattacaagagtgagccacctcagccagcatgttttttgtgggatctcattatttttaactgtctcatgcaatatctaataataaaatgtacatgtcttcttcattttatttctatatagagcgtgttttattaatacatgttgttacaacatctaattgcaaatacatatgaaactctatccaaactcctacccaatctcttggtagtggaaagtacatcagtcacaggaatagaacccagagtcaaggtcctgaagtttgggccttggctggagagcagagtagactcaggtcacaacaccaggatgggatacatggaggagaaggaggaagatggggggaaaggaagattctaggtctgccgaaaaagatcaggcaggtaaaactcagagaccttccagcaaggcccaaaacaccactagccacatgagaggtttcaagcaattgactcatctgcccctagtgggatttttaaactacagactggtataggaggtgacctgtttagatttactctcaaacctgctgtgttgggccactccaatttagactacactttgctgaagttctgaaattcaagaattgcttctcacctccttgtgacctatgaagagatgtcattatctgggtccacccacattcacttgggagttcattcaataaaactttgcaatataatgtaatgggtgtcccatagggattcggggcagaaatatttttaactctcattttgtttcaagtacaatagacagtaactaaattttccagaaaactttaaagatgcttttatctctgaaaggtttttcttttttaacccacttcagtcccactgatgttttcactagcttgcctccaggataatgcatttgatatcagtgaatgtgaatacacacttccaaatgctttgtgcaggctgatccactagctctctttagacttttgctaatcagaaattgctcaagaaggaaatttgtgagctgtttccaaattgcctactgccttagacttatgtaactatgacaggtttattgatgcagctgggagcaagtttttaatcttagaagaaaatgtttatttctaaatagaggtgcatatacttttcataaaagtatttctagaggctttttaaaatgctttgatggtttaaactaatagaaataataatctttaaatatgcttatcagtagcatccccagaattcacgtctttagtctttgtacgaattagatttcctggctaaacctgtgaaaaatctcatggtattaggaaatctgaatgttgtttctttgtattattcaggaattatatatttttaatttttaaaaagttaaatagatggagataatgttgcagtctgaaagggcagccctgagaacttataatcagtgctatggtggctgtcctgcattctttggggcagagcttcctgagttagtccccacagttactacctctccttcctcgcctttcctctcttgctgctctctccttcctatctttactaatttatcttcccatgtcaaccccttaaattctgctgctctttcatagaaatcacctcgttgtcccgcttctccaccactcatattctagattggtagatatggaccatacagatagtctaccatggctaccatcaaatatttttgttcacttcattgtgcatagttacctactagttattcattgggagtagtaatttgcaaattatttaaaaggaaaaattaaaagaaaaaactttttgctgtagtttccctttttttttttttttttttttttttttttttt

SEQ ID NO: 35 - DNA, 1390 bp, Homo sapiens
ccaagatttctcatccatggtttcaactaagaatattttattctctccagtgaaattttttacaattaggattgcaaaactacatacattcaggtagatctgtgcacatcattatctatttggaaaactgtctgtagaattgtgccgtgtaccatccatccagccatacgcagcagcccacagtcatgctgttctccattcatttatacattctctacatcatgttacttgcacacaaaagtccttacacatggctctaagccatttttaaccccctggaaagtgtaattccttgacttggcaccctttctcttaagaattgatgtcccttgcaattctgatgaatacgagtctctacctaattagacaaaaatcaattgcgatcaatactcaagaaatgaaccccctacacaacactctaaatttgctttctgatccctagcaggaacaactgtctattcattcatatactcaatactttagaacatactgggtacaaggaatcatactatatgctggaaataaaataatcagtgatgctgtccttgattttaaggaatttaaaacccaagtatggaagccaaacaagtaaattgacaatcataaaagtactataagaagcataagtaaggactgctatagaaatacacaagtgaacttttcaaggcatgcatgaaagagaaaacattctatagaagtttcattcatttacttaataagttaatattcagccggatctggtactaggtgccatgttaacaagtctgtattttatccagaaggaaatgtggaactattaatcactgttaagcttgcatgtggcataatcagtttggtattcaagaaaattctgaattactccacaggtaaagttttattgggataacaaagggaaagaaaaggagtaaaaagttattagaggttactgatcataaggaataggatgaacaaggaaagaaaattcagtgactgaaaagcaaataaataggaacatagcaaaaattcaggactggctaaagaacttgtatagtgtaaataacagagtgagaaaaatcgagagatcatgattcagaaatgttttaggatttttagatgtagaggaattttaggggacagtagatctagggtgtacccaaaagggaagacagctgaaatgttagatagttgagatgaagaccagtggaattgaggaggccataaacttggatgggtactccccttggaagctgagtttagccacttcgatgtttggactcaaagtaaagtataaaaaagacagtagtcttatgagtttatcatagtggataagacactatttcaggaggcagattgcagcatactaattgtatgctcttcggcaagttacttagctcttagattttcctctggg

SEQ ID NO: 36 - DNA, 38342 bp, Homo sapiens
cactgcagtctctccctccctggttcaagcaattctcttgcctcagtctcctgagtagctgggaccacaggcgctcaccaccacgcatggctcatttttgtatttttagtagagacggggtttcaccatattggtcaggctggtcttgaactcctgatctcaggtgatccacccgccccggcctcccaaagtgctgggattacagaggtgagacaccgcgcccagccatatttagatttattgtcgttttcttttttgttgttgttttcttgttttttttttttttttgagacagagtctcactctgttgcccaggtgggagtgcagtggcgtgatctcggctcactgcgagctccgcctcccaggttcacgccattctcctgcctcagcctcccgagtagctgggactacaggcgcccacccccacgccaggctagttttttgtatttttagtagagacggggtttcaccatgttagccaggatggtctcgatctcctgacctcgtgatccgcccgcctcggccttccaaagtgctgggattacaggcatgagtgacatcttacagataacgataagtgcaggtggtaagttgttaataccaaaggcaaccatattctttggacctaacgttttcttgtaggaataatttgattcattttaccgccaaggagcaagtgttcaagaacctcctccctataagggcagaaaatttagatgtcagtcttgctgaaatgccccagtgccctccttctcacgcatccaagagtttcctcatagcttggttgggtccagatgggcttggtcccatgtctacatataattagggtggagaggagttgaggcatacagcctggtgtcagcaagtcatgtcctgagcctggagctggacaaagcccagaactcacctagtggccaagggcattcaggagaggcagtgactcctacggaagttggtctcagcatttgtgctgccatctcttccggtctaactggccagagacatttaggtgaagacctttcacattgcctttctctcagtcaaggaagaggtcagctaaattggtccaggaactttgagtcaaactccttcaattccttgtcagctcaggggtgtagcgtggcagagagtcacggtggtaggtggataaggagttgggagtgtttgggtcttctcagtagaaggggctagggtaggggttgcatctgcctctggattttgttgttgtgttggtggtggttttttatttgtttgttttatagagacaggctcccactatgttgcctaggctggtctcaaactcctgggctcaagagatcctcccgccttggcctcccaaagtgctgggattacaggcatgagccaccatgccggcctgcctctgaattttgtgtcttctttccctgctgtagcatttaggctagaaccaagcccttttgcagcagttctggacacagtgactgcctacaaccgggcttggctgctgggacctcactccctactaggcccaagctcagagtgttctatctcttagggaccaactctttcatcataagtacattcaccccaggggcataacccaccccaggaaataggactcaactctgtaccaccgcagagaacaccgttccttctggcttctgagggaatgatacctcctgaacctgtgggatgcagcagcgccgccaggaccccggcttgggatgatctcccgctctgattatcaccaccctgtggaccaagaccatcccccacacccgctgtccagggatctactctcctgggaactgagcaggtgtcttcttaaaccctgaaagcccaaagtgtcttgtgagtttgccccttttctccagacaatgtggatccttgacctactcctgcaagggagggtcccctcttccactcttaccaagaaggagatgacacaaagtccatttctggtagggtgctactttaaaaggcacccgtcacacacatgcctcaagcccatctgaaattatccagggtgctggcctttctctacctatgcagctgccctcctggaagcctgggttgagagagatgcgactcgttcagcagcccgtctatgctcagggtaagcccgagcacgtcagcgaagtctccctggcatgggatccggcatccgggaagctaagaggcatcagtggggcaagctgggatggttccaatggcccatggcctcctctcagctttaccccacctcaccccaaccagagagatcagtaggctccttctgagggtgcctcctttctcaaaggcaggattcttccctccagtgcaatggatcatgacctggctggtccttctttctctctgatcttggcctcaatctaagtttcagtcaagtgaatgacattatcccttacctactaggaattaaataggttttaaagtacacacagacacacacacactttggaatatttatatcaaaatgtatgttttttaggccaggtgtggtggctcacgcctgtaatctcagcactttgggatgccaaggtgggcagattgcttgagcccaggcattcaagaccaggttgggcaacatggtgaaaacctgtctctgcaaaaaatacaaaatttagcctggcgtggtggcacacacttatagtcctagctacttgggaggctgaggcaggaggatcacttgagccctggaggttgaggctgcagtgaaccgtgatcgcagtactgtactccagcctgggcaacagagtgagaccccatctcaaaatatatatgtatatatggttttttaaaccaggtttcttgagatcatttcattgggaatttagaagaaaaagaggcattctgggcgtgatgtatggagaattcttctggagcgcttcatggaacccagcctctgaagcagaagaaacaactgagttccaccaaggagccctggtcacttcacggtgtcttaacttctccacatcttggagtcacttaacacttccaggacaccaaacagtctaacaacttagttctcatgaaagaatgctgctgggttgaattgaaaagcaggcagagttagagaatgtgccttctacaaagtagccatctcagagagacttgtttgagtgaatagaaaaatgaaacctttagttaaagcaactgagtattgaacatacgcatgctttagaactaaaaaataggccgggcacagtggctcatgcctataattctagcactttgggaggccaaggctggcagatcacttgagctcaggagttcgagaccagcctggccacatggtgaggccctgtttctactaaaagtacaaaaattagctgggcgtggtggtgcatgcctgtaatcccagctactcaggaggctgaggcagaagaatcgcttgaaccctggagctagaggttgcagtgagctgagatcgcgccattacactccagcctgttatcccagaactttgggagttatcccagaactttgggggacagagcaagattccgtttcaaaaaaaataattatgattttaagacttgtgctttttaaaaaacaatttggaataatattgcaatgcttttttgtttgtttgtttgtttgtttttgagatggagtttcgctcttgttgcccaggctggagtgcaatggcgcgatcttggctcaccgcaaactccgcctccaggttcaagtgattctcctgcttcagcctcctgagtaactgggattacaggcatgtgccaccatgcccgtctaattttgtatttttagtagagacagggtttctccatgttggtcagactggtctcaaactcctgacctcaggtgatttgcccacctcagcctcccaaagggctgggattacaggcgtgagccactgcgcccggcctgcaatccttatttaattttaattttttgtggagacaaggtctcactatgtggctcaggctggtcttgaaatcctggggctcaagcgatccgcctgttttgacctcccaaagttctagcataacatgtgtgagccaccacatctggcctgcaatgctttttttggccaattataagttagctatattaaatgagactaacagtgatgtttaatgatactaaataagacctggataatataaaccaccttttatgtgatcattaatattttttatggtaggctgtaagtgtacagtgacagaaatgaggttcaaaagccaagcaggtatgcctgggataagttatagccttttgttagctttatgccactagcattcataaggcacatactatattcaaggacagcgctatggtgtgagtgtttgcatccctccaaaattcacatgttgaaatcttcttttttttttctttttctttccttgttttttttttttttttttggcaggtaaccttctgagctagagtaggctcagagactccctcatctgttgaaatcgaatctccaatgttttgcctttaagaggtggggctgttgggtcatgagggcagaaccctcgtgaatgggaataatcccgccataaaagaggcctgagggagtttgcttgcccctttcctccttccaccatgtgagaatgcagcaagaaggtgccctgtatgaagcagagggccctcaccaggcaccgaatccggtggcaccttgatgttgaacttctcggccttcagaactgtgagcaataaaattccgcactttttttctttttgagattgagtctcgctctgtcatccaggctggagtgcagtggtgcagtctccgactcactgcaacctccgcctcccaggttcaaactattctcctgcttcagcctccagattagctgggattgcaaactccacctcccaggttcaaactattctccagcttcagcctccagagtagctgggattacaggcacctgccaccacacccagctaatttctgtatttttagtagagatggggtttcaccatgttggccaggctgatcttgaactgctgacctcaagtgatctgcccacctcaggctcccaaagtgctgggattataggggtgagccaccgcgcccggccacattctgctttttataaattacccagtctaaggtattttgttacagcagcccaaatggactaagacagtgtatttagactggagggcatggggtttgggtttagatatttgaaattgcagagagatgggctatgcctcgcctttgtctgcaggtctaggacaggttctgaggaatgtctgtagtgtcaactggacaatgcaatattcaaacataacacagaaaatggaattccttaactcttgctctgcttctgtcttctcaaaaaagaacatttttcaaatcaaaaagaacaaatcaaacctatgaggagatggtatgagaatattttcatagtaaagaaaatggaaagaatttgtggaggtgattgggaaatcttttggatgatctctaggaattatgaaaaataaccgagccacagagatgggaaatacgtaattctaattttcaaaaagaaaaagaaggtgggttctatgacctatagatcagtaagcttgagattgattcttggtgagagtgttgaagagaatgctagaaggtggtttctgagctcttagaaaccagcaggcagtgattatagtcagccccatgtcactaaaagcaaattgtgttagcctgattccatctccttttctgataggattactccactggcaaacttagagatacaagatggatatggtccctctacacttcagaaaggaaactgacatagttgcttgggtgccctggggataaggtacagaggcagagtatcactcgcagcttttaggtcacaaagaacagaaacaaattctagtgagtttaaacagaaaagggattttattcaaggatatagggaagtttaccagctgtccagaagggccagacaatcaggctcagatatcctacatctgatgtgatttatggatttttggatgcagagccgcatccacaatcacagccctggtctttggagggcatgacagcttgtcaacatcggcatgaacaccaaggtttgccctgctgacacggctaacactaaccctggtgtcctgaaaagggtataaagctgtccccatcctctgccaaaacagagtccttaaagtcccaacgtttttgcctctccagctcctgagtcaaagttcagcccaatgcctctgtttggtggagcccagatcatatgcccacaccttagctatggagggagctgggaaagccagatgctgacctgtttcacttctcatgggaggaggtggtctctgccttctgacagactcgcaaagtagggaattctcccacgcagaaagtggggtcagatgatgagctgccgtaaagaatggctaatgttgtcctcacaggggttgagggatagggtaattgtgctggtttttaacgggttgaaggatcatagccaaagcttgctaattaattgattctttttaatccagaggactggttttattggaataccacagaactctgcattatcgtgccacatgagggttttttgttgttgttgtgtttttttgtttttgtttttgttttatcagtggcttggccaaagaccaaaaataaacttgttgtatttgcaggtgacacagagaatgagtggaatactaatacattgaagggcaaaatcaaaaccccagaagatctctaaaagtctgaatgaatcagcccatattacaagataaagtccataatggtaaacggaaggctctggtcttggtttacaaaatccaaccactcaaatatgtagttgctggtaagaaaaaaagccataatttcatgtggttgccaagaaagctcattaaatccttggctgcattaatagatgtatggtatttccaacaaagccttctgcctcattctgcactggagagaccacagctgagccctgtgccaagctatgtgcaccacagttttcaaagggctcgacgagttggaggctgttcagaggggagcagcggggtggtagacactctcagccccttcgtagaggaagaatgataccaccgcaggagctcggccatgaagaagggccatggggggagtgatgacatagtggtcaccaattttctacagagctttcacatggaagatgggtacgatttatcccacggggtgtcaaggcatgaaattaggtacaattgatgtaaattatagggaatcttcagtctaagaaagggtttccactggagcaacccaaaagtggatgagtctatgttgggagggagcaagttacctccctgtcactgaagacgttcagattcgagactggatggccagcatccaggggtgctgtcaaggggcctcaagctatgtttagtctaaacgaactttcagccttaagagtatattttttttaatgaaaacataaggcattacaaaggagagatgagccaggtgtggtggcatatgcctatggtctcagctactcgggaggtgaggtgggaggatcttttgagcctagaagatagaggttgcagtgagccatgattgcaccactgcctgggtgacagagtgagaccctgtctctaatgttaaaagaaaaaccacagagacgtttaacttaacagagtttaattgagcaaaaaattatttgtgaatagggcagcccctggaccagaatgggttcagagaagctccagcttaggcacatggtggaggaagatttacggacagaaaaaggaaagggatgtacaggaaacagaagcgaggcacagaaagagccaggctggttactgctggatgattgccttgtttgttcatggtttgaagaactgcccgcctttggccggaactgggtgattgacacaagagtaggcagccgtgtgtttacacaccctgtcaggtgacagtgcactatgcatgagcacagctttaggcagaatgtaaactataaggaggcagcattgggctaaacttaattttacactaaataaagtctaaaaaatttaaaagcatttttaaaggtaatagaagttagctgtgatgtgcatgtgaacatttaaactacatttttcgttttttttttaaaaaggaagttttgtggccatggggatgctgacaaagattgcttgggatgcacacaaggcagcggcgaagcctgaggggtgctgccaggccgggctctccactggccacggtaagaatcttcctgggcctgtttgttttggcctctgtgagcatgggccacaatcacggggaaatgaattgctaggaagtcaattcctctctgaaggaaggactccaaagagagctgaggctgccgtgttttctggccgcccacacaagccaacaagctattccctgggggcaaccactaatctctaaccagacaaccggtaatctcttattcattctccgttgaattcttgggctacactcaatttataatagaacttaaagaatgtcctcattttatctagagggtttgtaatgcctttatttcgattcctcatgaatcattatagtcatggatacctgtgaaccacagcttccttgtagagaggggagaggggaataagtgaaattactccggagaaaacaaacaaggacgtttagctccagggcatgtggagagccacagtctgagtctctcactcgcataccaggagataaataattcagaggcctaacaaagggaggcggagtagtcaaactggttgaacacctggtcggctgcacccagctaaacagggctggtgtctgtgagggcttcctaatcattgtggatgacatttaaagacaacactcatagcaaatattgcattagaattttctgcttccaagataccagtcagagtaagggtgggagagaaatgagggaaagaacagataccctactacttatcagattgccttagagtacacatcatgaaagtaattatgattttctttttgagatggagtcttgctctgtctcccaggctggagtgcaatggcatgatctcagctcactgcaacctccatctcccaggttcaagtgattctcctgcctcagcctcctgagtagctgggactacaggcacccgccaccacgcttgcctaatttttgtatttttagtagagaaggggtttcatcacgttggccaggctagtctcaaactcctgacctcaggtgatccacccacctcagcctcccaaagtgttgggattaaaggtgtgagccaccacacctggcctaattatgatttttaagatgacaacagggctatcaatgttcatgtctttgtgtcctctataagagatcaatgtatctcttgcctgaatacttccccagattagatttctggaagctcaaagtagtgctgattgctgtctggtcctggtcttgcaatcacaccccaccaaatgtaggcaaattgtcagtgtacaaggctgcctctgtggtgggaacattttgggaacataaaagggaggcagggatttctcttttttttcgagacagagtctcactttgtcacccaggccggagtgcagtggcatgatctcagctcactgcaacctccacctcccgggttcgagtgattctcctgccttagcctcctgagtagctgggactataggcgcccaccaccacgcccagctaatttttgtatttttaatagagacgggggtttcaccatgttggccaggatggtcttgatctcttgacctcgtgatctgcccactttggcctcccaaagtgttgggattacaggcatgagccaccgcacccggcctgagggcaggtatttctaatgtgtagtgggtttcaagtttacagtgacatctcagagctgcaaaaatgaaacattatttctctataactgtactcaatttacttatgaagtagtggaaaactcttcatcttggcactttaggataactgacacccttctggtttcaaagcttctttagggtaattcctcagtcaatccaggattttaattccatcagggccacactccctcatctcctcctctggatgagccccaggtctgtcccatgcttcctgttctccggccccccttggccttggagacatcttgttgccttggtggtgcgtgtcagtcttggtcactgttgccttcaccattgacccagtttgtcagctgctcttaggcaacaaaaggagaggtggctgttccctgccggccaggccccgtcactgcagtggcagtgctgctctggccaaggcttcattctctgccaccttcctcaccctcaccaggcgctacgggctcttcccctgatttccccacacaggaaggaagtaggggagactcaggtggggcggttcttggaggcccattttcagtccaggtctgccctgcctgcctttccgctctgcttctctcccctctcatgttcttgtggtgctggaagcaagggttttagagcaaacaagggccacgtcccttctgcccttacccctgtactctctgtcccctgccagtgaaatgtcggctaaggaggcagagccaccgcccccttgggaacaagcacacctctgtctgtatctcttacaactcttctctcctcccccatttctgctccccagttccctgggtgctgagtcaggaaagcctttatttcccccccctcccccagtaagcttttgcagtgccaggaaagctatttttttaatgcttattaaaaaaatttttttttcgagacagagtctcattctgtcgcacaggctggagtgcagtgacgcaatctcggctcactgcaacctccatctcccaggttcacgccattctcctgcctcagccttctgagtagctgggactacaggcgcccgccaccacgcccggctaatttttttttgtatttttagtagagacggggttttaccatgttagccaggatggtttcgatctcctgacctcatgatcctcccacctcggcctcccaaagtgctgggattacaggcgtgagccaccgtgcccggccccggctaatttttttgtatttttcgtagagacggggtttcactgtgttagacaggatggtctcaatctcctgacctcgtgatccgcctaccttggcctcccaaagtgctgggattacaggcatgagccactgcgcccggccaaaaaattttttttgtttaaggaatagggtcttgctatgctcaggctggcctcgatctcctgggctcaagcaatcctcctgcctcagcctcctaagtagctggcaatacagatgtgtgccaccatgcctgggcagcaatttgtattgctttcttttatggtggagaaatgaccttgtgccatgagctgcatcctttagagcagggtgtccaatcttttggctttcctgggccacattggaagaagaatcgtcttgggccacatataaaatatgctaacactaatgatagctaatgagctaaaaaaaaaaaaaattcaaaaagtctcataatgttttaagaaagtttatgaatttgtgttgggctgcattcaaagccatcctggccacagattggacaagttgctttatcgtaacacctataaatgctatgctctgtcccccaagcttttactatcatcttgcttatttatgcctagtgttccattattggaacggtaagcatgtgggagttatttatatcctactgctcaaggcatttccaaggtctgatttttcaaattaaaaaaattgccacctcagccataaatgggttaaaactaagccattttgaaattcagaacaaaactgcctctctctcacatgactagctctttcaagcgactgtggcttcagatattgtgaattatccatccgctcagcacctcctggctgctttgttctcgctgttttcactttctcctgaagtaatgaatgccattgagccaatgggggcagagtcaataactttgaagaaaaagaacctcagtttaaaatttcaaaatattatttttaatttttgataacttatatgccttcactccaaataaatgaagatcaaaatatgtgaataaaattcaagatgacaggccgggtgtgatggctcacatctgtaatcccagcactttgggaggctgaggcaggcagatcatgaggtcaggagttcgagactagcctggccaacatagtaaaaccccatttctactaaaaatacaaaaattagccagagtgatggcacatgcctgtagtcccagctactcaggaggctgaggtgggagaatcgcttgaactcgggaggcagaggttgcagtgagccgagaccatgccattgcactccagcctgggtgacaaaaaaaaaaaaatcaagatgacatcactctagtttgtcccaatcctggtgtagcttgagtaaggaaaagcagatgccctcgttataggtctaagtctcgcaccaaggttgctcatgtttctgtttttaaaccttccacaaagaaaatcacatgtaggtcacactgtcctcactaatatctggtggagcctcatatcatctggattcctgttttcacctataagaactgatagttttgtttgtttgtttttgtttttgagacggggtcttgctctgttgcctaggcaggagaagtgcagtggtgtgatcatagtttactgcagccttgacctcctgggctcaggcgaacctcccacctcagcatcttgagtagctgggactacaggcatgcgccatcatgcccagctaattttttgtattttcagtagagacagggttttgccatgttgcccagcctggtcttgagccccagggctcaagggatccacccacctcagcctcctaaagtgcggggattacaggcatgagccacctcatctggcagaactactttttttttttttttgagatgaagttttgctcttgtcgcccaggctggagtgcggtggcacgatctcagttcattgcaacctccgcctcccaggttcaagtgattctcctgtctcagcctctcgagtaactaggattacaggtgtgcaccaccacgcgcctggctaatttttgtatttttagtagagacggggtttttgccattttggccaggctgctctcaaactcctgacctcagatgatctgcaagcctcggcctcccaaagtgctgggattaccgtgagccactgtgcctggcccagtggaaatgatttttaatgaggcagagggagcagcgtttgattcacacacatttagtgtatactgttttcaacagtttaccacatgctgcagggggcagaggtggatccaggttttgggaggcctgaagcttacagaatctgggcgccctttttaagtagaagaatacaaagttatgtagataaatagttatcacataatgagcaaagaatgtacagcaaatcacattatcaaaagctaacaaatcacacaaaatcataaaactccaaaaagtacataatattttattaaccacttgctatactttttttttttttttttttttttgagacagagtctcactctgttgcccaggctggagtgcagtggctcgatctcggctcactgcaacctctgcctcccaggttcaagagatactccagcctcagcctcctgtagctgggattacaggcatgagccactgcgcctggcccacttgctatacttctatcgtactcccctaccccttgtattttttggctgtgtattcttaggtgaccttttgagagaaaacaattttataatttcattttctctaaagagaatagaatcattcagtttttcttctagcatggtggattgcaatgtacttatacatagtttgaaagttttgtttggtaatgtcatttaaaactttcttttttttttctttttttttttgagaccgagtctcactctattgcccaggctggagtgcagtggtatgatctcggctcactgcaccctccgcctcctgggttccagtgattctcctgcgttagcctcccaagtagctgggataatatatgtgtgccacaacacccggctactttttgtacttttagtagagataggcgtttcaccatgttggccaagctggtctcgaactcctgagctcaggtgattgcccacctcagcctcccaaagtgctgggattacaggtgtgaaccactgcgcctggcctgtcatttaaaattctatccaaggttgttgttaaatttggtataacctctatcaagttctcttgatatacatacaagctataaaattggaaagaatattcccccagactggcttctggctccaaactgtgttttatgttcatgagacacatacttgtggtgccagaagccacagcacacatttatatcatgatgcaaattttggcctgcaccttcatgtcctgatgcccagtgagttggcacagggagagggcgttttcctggaagccattcctacatcaggatgagtagcaataacttcaactatgcacagacacatctgcaaatcagatgactgtgttttaccaagtccaactaaatgtacccctaactcaacttgccgttagccaattccccaaaatgctcacagccacttctaggacccctaacacaagtggcgttggagcagaatgcaaatgatcttaatcccctaaaattgcagtttcttacttatagaaattttatatataaacacacacacacacggctaagggtccttgtagggccttggaaggagcccgtgcaaatgagggattctgaagcttcaaccccattagcttcactgcacagccatagctgatggggtgggaggatggatgctgagcaaagccagaaatcaggttcttgctgagaagaccaacacaaaagaccacgatgccacagtccgcagtccagtgacttgctgactgtgtcactctgaaggagagatacgggtgggataaataaagccctgagtggcagctcagaaggagccaggggggattttctgcaggccccggtacccacagttacatcgccctcttggtacagcctcatcatgatgagtttcaagagagaattcaacaacggctctcctcccttaactgtttggatgctaaagtgttgtgatttttgttattactgtttctaattcagatggctgatcaaactcggtgttttctgatgcatctgtgaacaaagattacacttagataatgtctaaaatgcaatgccagctgagtgcagtgactcacgcctgtaatctcagcacttagggaggccaaggcaggaggattgcttgagccaaggaatttgagaccagcctgagccatattgtgaggccccatctccacaaaaaaatttaaaaattagcctgcagtcccagctatttgggaggcagaggtgggaggatcctttgagcccaggaggtcaagactgcagtgagccatgatcatgccactgcactccagcctgggtgatagagtgagatcctgtctcaaaaaaataataaaataataaaacaaaataaaataaaataaaatgcagtgacacttctaccctcatatgctggagtttgatgggggagcacattgatttagatgccgcaaaagcagcatttagctgtggaattacagtcgttacccatttgggtatattttactctgcctggaagagttcatgtgtttcacggttgctactaggtaaggacgcaggccctgggagatcctggttcaacagtgactgtcttatgtaacagagtcattctctttatgaccaccttaggaaccgctaaggaacataataagaaatacacagaactgattgtggaactgctctttctccctgcgattcagaggggaaaagataaagccacacagccctggggcctcttgcttaagaacacatctcagtttaaccaccaaggccgttatgataacaaatgtcagtatggaggtgtgaacatcaggggctattcaaggacgcttctctgatcactgccatgtctatctgctgtgatcacgactattttataaacacccttcctacccaatgccatcagaattttagggacgatgcttcagtaattatctttttttccctccttcctccctattttctttttcctctgaatagctgccaaagtaactagagtcatataattttagagctggaagctcagggagaggcttggatcctgatgacccaagcatgggaggggcctgaaaaaatgtcaacagcgctccgttgttgatcccacacatttacttaatatgagctggtgctggcagaggtttatgttggaaaggctgcaactttctgtgccccacataaatgagataaaacctggggaaaggagtgttggtttaaatcagaaaggctctggtttttatttgatactaaacaaatcatgcagtttacaagtctgtgacactctaagagttaactagcagttttgttttttttcttttttttgagacggagtttcactcttgttgcctagtctagagtgcaatggcgcaatctcggctcaccgcaacctctgcctcccaggttcaagcaattctcctacctcagcctcccgactagctgggattacaggcatgcgccaccatgcgcagctgatttttgtatttttaatagagacagggtttctccatattggtcaggctggtctcgaactcccgacctcaggtgatccgcctgcctcggcctcccaaagtgctgggattacaggcgtgagccactgtgcccggcctaatcagcagtttttaacatgctacacagggtctgggaaagacagctgccaagttgggggctttgaaaatatgagacatctgtaaataataacctttgggtatttcacctgtgtttgcttctttatattacttttgtgtgtgtgtgtgtgtgttttgagacagagtgtcttgtcacccaggctggggtgcagtggcgtgatctcggctcactgcaacctccacctcctgggttcaagcaattctcctgcctcagcctccctcaggcacttgccacaatgcatggctaatttttgtatttttagtagagacggagttttgccatgttggccaggctggtcttgaactcctgacctcaggtgatccacccgcctcggcttcccaaagtgctgggattataggcgtgagccaccatgcctggcatatattactttgttctaaaattaatttagatctggcatcctctttttgtccctcaaatgttattttaccaaaacatatattattgggacaagaggcaaattgcatggccaagttgaatgacgttattccccactctgacagcttttgtttttaactctagaatttgtacatatggctttggaaacctcatccaacactaagtaatgaacatacatgaggatactatgtatttttcaacctgcaagcccaagatttcaaattctttggtttatcgcagagaacacatctctcaaattgtcttcaaggagcactgcaggaggtacaatccattccccactaacccaggaagactgtctgaattttttcagagggaagatgggtgggggagaagtggggatggttaatgggtacaaaaaaaaaaaatagaaagaatgaataagacctaatatttgatagcacaacagggtgactatagtcaataataatttaactgcacttttaaaaataatgaaaagagtataactggattgtttataacataaaaaataaatacttaaggggacagatacctcgttttccatgaggtgattattatgcattgcatacctgtatccagagtatctcatgcaacccataaatatatacacctactatgtacccacaaaaattaaacattaaaaagttaatctttttaatgtttaatttttttttttgagacaggcgtggtcttggctcactgcaacctctgcctcctgggttcaagcaatcctagtgcctcagcctccggaatagctgggattacaggcctgtggcaccacgcccagctaatttctgtatttttagtggagacagggttttgctatgttggccaggctgaactcctgacctcaggtgatctgcctgccttggcctcccaaagtgctgagattacaggcatgaggcactgtgcctggacagaaagtttttaaaaaaaatttgttcagagggaacccatttcctcttctgctacacagacagccaggcctgacttgcactgtttctatccccccacaaaaaaagcaacaacatcaccgagaagatagttctgtttgtcttgatgatcaacatagatctgtatagttgattttgtgccagcaacaggctccagtcacaacaacatgagattccaggcctttttgcctgccatgctggacacagactgggccatagagaataggagaacccgtgtgttcttctgagttgtctgtgaagaaaaatacacggggagaggggtagacgtgagttcctggaagagtggagatgtgtggggaattctccagcgttccttaattagaaacacgactcagtgatgttctttggagcccaagaccccaggaggcactgagtccagtggtcccaggaagctaaaaatgagggcaagagtcagcgtggctttaaaaatctctgatcactcatcccccagaatgaaatctgggactcaaaagctctgatggaaatgaagcagactttaggaggtctggtttcgggggtgctccaggagctgaatgtgaaatgttatttgttccagaaagtcctggcaacttggcgcagcgaatttgatcagcaccatacgtacgacctgtctcaggaacggtgccatgtgtgtgactaggactgcaaagcagcttgtgttcgtgggggaaatgacaggcacaggaaggaaaagctgagaacactgaaacggttcctaatcgtgcagtggggaaaggagggcgactgccgcgcagagtggcacgttggctggaagaggggattgatcagcagtgctggcaggaacagcataggcttgtcgtgtgatctaacagaagaggcagcaatctggaggcgccccagatcagagaagagacatcaagccccaggagaaatggatttcctttctccccacccatcagctgggtaggaagcccgaaggagcctttcatggaactatgggaagggctcctctgacgcagaggggatgaactggaagcaagatgctgactgtttccaaaggcttgacagtcagaagcaggcaggcttcagcctattgagatactttacccaagaggatttccgcttaggttctgtcttgaaagaaatattcgctcccaaatttcctcccatcaagagtgcttctccctacagaaggctaaggctcacaggttgtccccagggacacatttctttcaagtaggatgactggtatgtttagactgaaaagctgatttactggaagattgctatcaccccctggcctaccatgtcgttggtgtggccagtgtttatcagacagtggtgtttccagcttaggcctgaatggaagaagaaactgaaagaagaaataaaaagagagatgcgccgggcatggtggctcatgcctgtaatcccagtgctttgggaggccgaggtggcagaccacttgaggtcaggagttcaagaccagcctggccaacatggtgaaaccccgtccctactaaaaatacaaaaaattagctgggtgtggtggcgtgtgcctgtggtcccagctactccggaggctgaggcaggagaattgcttgaacccgggaggcggaggttgcagtgagccaagattgtaccactgcactccagcctgggcaacagagtgatactctctcaaacaagacaaaacaaacaaaaaagaggaggctcggcacggtggctcacgcctgtaatcccaccactttggtaggctgaggctggcatatcacttgaggttgggagttcgagaccagcctgaccaatatggagaaaccccatctctactaaaaatgcaaaatcagccaggtgtggtggcgcatgcctgtaatcccagctactcagaaggttgaggcaggagaatcgcttgaacccgggaggcagaggttgcggtgagccaagatcacgccattttactccagcctaggcaacaagagcaaaactccatctcaaaaaaaaaaaaaaaaaaatggagagagagatgtttctcagctttgggaaatgctgacttttccagcacacctttgctcagaaaagccctatgatataaagtgtcataggaaccttgtccttggaaccaagcctagcctaggctcagggacatcatgtgggagtgacataaaggaggctcctctgtcactgtgcttgggttacaagtaattctcgacatgggagcatgttgatttctaaccatcggtggcggagctgtgacttcccaagctggtggctgacctcaagaggactattatagacactgtgggaccacggcctgagaaaagaatggctacctccctctctatcccatgacctctaacggcccggtcaccaccatggccttttgttcctggagagggacaggaactttggaaagtggggtcgctctattgcttctgcaggtcatcttcccagacttgcctaagcctcagaatctcagtcttctgctctgttttgcacgtcttttttgaaaggtttttaaaaattacaatctactgtacagaagaaaataatacacagaaaataattttagaaaataatacaacagatatctaagtatccaccacccagattggacaacatattaacattttgccccatctatatcagatattatttattttcttttttacttatttttgagacagaatctcgctctgtcgcccaggctggagcgcagtggtgtgatctcagctcactgcaacctctgcctcccaggttcaagcgattctcctgcctcagcctcccgagtagctgggactagtggtgtgcaccaccatgcccagctaacttttgtatttttagtagagacagggtttcaccatgttggccaggatggtctcgatctcttgatctcgtgatccgcccgcctcagccttctacagtgctgggattacaggcatgagccacctcgcccagcctatttttattttttttaagacatggtcttgctctgtcacccaggctggagtgcagtggcacgatcttggttcactgtggccttgaccttccaggtgcaagcaatcctcccatctcagcctcctgtgtagctgggactacaggagcatactgccacacttggctgattaaaacattttttctttctgcagagacagggtcttaccatgttgcctaggctggtcttgaactcctgggctcaagtgattcccctgcctccggctcccaaagtaatgggattacaggcatgagccagcatgcccagcctatatcagatttttttaaaattgcagatagaattaaaaacttgcttatctatttttagtagagggaaaaacctaaataagtttaattctagtaagttgctgactctacacaacaacttcctttcagtcttcagataatggaaactttgtggatttatgcacagcacccaaaccccagagatctgccccaacagaaagattgccaacaaaatgtttgtcttaatacttgaacaaatttttctcaaacttacattgtatatttttctccaccagtttgctaaatgtccacaaggttaatacccgcccagccaaatgaaaagaccactgggatcaggtgcggtggctcacacctgttatctgttccagctacttggggaggctgaggtgggaggatcgctgtagcctgggaaatcgaggccgcagtgagctatgatcaagccactgcactccagcctggccaacagcgcaagagcctgctctaaaaaatcaaaataaaaaaaaaaagagcattgggtctccaaaggtaacaggtgtgaaatacaccttagcctactcagaattttgccccatgaaataagtaaggattattaaatatttctggaaactcaaacaactctttaaacaatgttcacaatttttcaatgtccacatcagccaaacccacggaaagctaagcattaattcacctactgttggagaggctagactatttaaggaatctctcctgaattctagtcctgaatttccaatgcaactcgtgtccactagaatgttctgtgaatgtttcaagcttgaaacgcctgcagccaaacttgttttctttccatccaattatatcctctttccaatgttccccttttttcattaaaggcaccactattcttccagccatcctgattcacagcctcagagctggcctcaatttccttgtctccttcgtcttccacatccaattattcactaaatcctgttgaatttttctcaaaatatttcttgcacctgtttactccattctgctcccactgccacctttctaatgaagtattttccacctgtgtgtttcggctcctgcagcagattctgcatctcccctttctcctttcaatgaattatcagtatcagattaatctgctgaaagaagcactgtgtgccatcctgctcaacataattcagtgattcccagatggcttaccaaataacagcttttaaaaaaatccagaaccttcagtgatcttcacgatctttatatgtccaccttcctagacacatcccacattaggaacccattgaaacctctgccccaggcgcatggcactactggcttgctaattctgattcctgttcaagtatttctttggcctaagtattccttcccctccttcactacatgaaccaatcttcatggtgcttaatatgaaccagatcatctggtgggcctctaatacaacagtgaacaagacagaaacaacccctgcctccatatactccttacagcctagtggagaaaacaaaagatgaactggcagttggcatgccaggctgtgcaggaagaactgtgacaaggaaagacaaggctgaggtgggcggatcacttgaggtcaggagctcaagaccagcctggccaacatggtgaaaccctgtctctacaaacaaaaaaaaaaattagctggtgtggtggtgggcgcctgtagtcacagctactcagtaggctgaggtgggagaatctcttgaacccaggaggtggagattgcagtgagctgagattgtgccattgcactccagcctaggtgacagaatgagacgctgtctcaaaaaaaaaaaaaaaaaaggccaggaccccagagccaggcatggggattcagagcaggcttttcagaggaagggatacccaaccaagttttgatctgttcttcatgatggctagtgaggtgaaggagagggagaagggtcagaaaagaactctacagcagagagaatcatcctgctcagcccctatccaacctttaatgcccacctcaaatgccttcctttttttttttttttttttttgagatggagtctcgctctgtcacccaggctggagtacagtggcaccatcttggctcactgcaacctctgcctcctgggttcaagtgattctcctgcctcagcctcccgagtagctgggattacaggtgcctaccaccatgcccggctaatttttgtattttttagcacagacagggtttcaccatattggccaggcttgtcttgaactcctgacctcaggtgatccggctgccttagcctcccaaagtattgggattacaggcatgagccactgcgcccagcctcaaatgccttcttgaccaggccggtggtgtactgtgagaacacagacttaaagtcatccagaaacaaatcctaaccctgcctctgctgcatgctagttgtgtacatgaccacgcaaaatttgctcattctcaatatgagtcaatctctgaatctgtaaaaatactctttcttttgacagggtctccctcggttgctcaggctggtgtgcagtggcatgatcacaactcactgcagcctcgacttcctgggcccaagctatccttccacctcagcctcctgagtagctaggactacaggcgtgcaccactataaccacctaactaaaagacaatttttttgtaagggtggggtctcactatgttgcccaggctggtctcaaacctctgggctcaagcgatcttcctacctcagcctcccaaagtgctgggattacaggcatgagccactgtgcccagcagaaatactcttacattacagagtttattcattaaataaatattaagcacaagaaccacatactcttctccgtgataaggatacacttaagaataggatagaaatcttggctcttatggtgcttacattctagtaaggaaaaggtgacagtaaataagataaatatgtacattatggagtatattggagggtgatggattctatggggaaaatacgtcagagaagagagagagtaggggggaattgcaactttattcatttgtttattatttaactcatttattcaaacaaatagtattgaaggtctgctacatgccacaccctgttctaggccctgggtgtatagcagggaacaatggacaataacctttgcctttatggagcttacattctgatcagaaagagagataagcaaaataaaaatagaaaaatatggagatgtagccgggcgcagtggcttacgcctgtaatcccagcactttgggaggccgaggcaggcggatcacctgaggtcaggagtttgagaccagcctggccaacatggtgaaaccccatctctactaaaaatacaaaaattagtcaggtgtggtggcacatgcgtataatcccagctactcgggaggctgaggcaggagaatcacttgaacccagcaggtggagattgcagtgggctgagattgtgccattgcactccagcctgggcaacagagcgagactccatctcaaaaaaaaaaaaaaaagccaggtgtggtggctcacatctgtaatcccagcactttgggaggctgaggtgggtggatcacgaggtcaggagttcaagatcagcctggtcaacgtggtgaaccctgtctctactaaaaatacaaaaattagctggacgtggtggcacgcacctgtagttccagctactcaggaggccgaggcaggagaattgtttgaacctgggaggcggaggttgcagtgagccaagaaggcaccattgcactccatcctgggtgacaagggtgaaactccgtctcaaaaaaaaaaaaaagaaaagaaaaaaacatatggagatgttagtgcaaaatagaaagatggataggaaaaatagtagatgagttccaacattcaacagggaggccagctaacccgactgagaaagcagtagttatgaaaaggtgtggcgggatctaggccagccgtgtgaacaaatggaggaagagaattccaggaacagcaagtgcaaagatgccacattgggactgcatggtgtgggcaggaggagcaagtgaggggagagcagaaagaggcaaacaggggagagcaaggcaggtcagggccctgtgggttattgtaaggactttggcttttactcggagtgacaaggaaacctagtttggagcagaggagttacccgatcagatttgtattttaacatggtggcgctgggtcaagaatagtcaagaagagggaccagggcagacgctggcagggcagctgggagaccaccgcaatcacccagacaaggggtaaggagggtgtggacaagcgtgatggcaacagaagacgggcagatggcagggttctggatgtatcttaaaagcagggctaacaggacttgtgatcagatacgggatgcagaagaactaaattgattccatttttggcttgagcaactgggagaatgaaatagctctttactgaggcagggaagactctgggaggaaaaggttggggggaactatcaggagtccagcttttgatgcgttgagtttgctttagggtgatcctgcaaagtttcactgcaaaggggatagttcagtaaagacttgaaggaaatgaggagcagaacttgggaagattaaatgaaagggtgtttgagagggcacttcgcatagtgcagtgccggccagctcaggctccgttaattccattccctcatccataacaaacttcttccgctccagggggcaggggctgggaagcatcagttcattattggaaaatcctcgctctagtgggtaggctgcaccttgtgcattgtagttgccaaactctatttgctgaattcacgagagaaaggaataagctataatcagtaaaggaaactgttccaaccagcttccctttctccttcccttccaaagaagaggtttgagccaagatgctcttgtgtccgggtgaggggaattagaggtctgaatcctctgtcttatggtgaacacagcgtgggggttctctgagtgtagaaccacctgcagcccaatgagcagggatagtggtaaaatatgaattcttggaccctttcccagaccttctcattttgagttgttaggggagaaacgggtatctttctgttacagacacatgcagtgcttccttggaaactaaagtttaagaactactgacactagggaagatgacccttcattgacattgctcctcggaggcagatcatttccagccatgatgtggtaaattacagccgctctgcaattttatgaataatgtgtgctcatcacctaatcaaacctctccagtggaggtagaacctggctggctcagatccccactcacattgtcaggtgattgctttagcaaaaggccttctgccaaatacctcttggttgaactttgcagcttgaggagagaagtatgcacgaacacataaatgccaaatctcttattattctgagttttcaaacaatgaatacgattccaccccacattcttgagaaagggcagcacacctatctcaccctcagctgtgatgaagcaagaaactcagtttcttcacattgctcggtgagtctataccacaaacaggactaaaagtcacatgttggctttgggcaccattttatcgtgagcctttcatagcccatcttccaaggctattaaaatatcagctccatgagggcaacattcgtgttgtttattgctctcttcccagtgcctagaagagtgtgtggcacacagtagtcattcagtaaacggcagaatgaatccattccacttcctaaagtgaagagccaaatcgacacacattcccatctgtggagtatcacagtttcctgcagtttacttccacatacctcactccaccagttaactaccccctatataaatctgtgcagttttcacttaagatataactttctggtgaccccataaaaaattggcagaaattctcagaaaggatgataatgtaattggtcttgtggggaatccatggagggatatatttcacattattcatgtttccagatgggcttcagtccccagtgcagtcattccagaaccctttctcagcgttaagtttactccgaaaaatataaatagtgatttagggcttgattgctcccacaaaaggcacccctgttttggtgcagggtgggaaggggggcagaggaagaggcagctgggaagctgagtgaggggccaggcgcccgctgggtgtgagccagcagctggtcagagtatctctggaggatgagggtttcgcaggtgggggctggggactagctagagatgggattgtccgtggtcaggcagttcaggaagctttcagcagcaataaagcttggatgtgggcatgccaagcttggaggagatatgggtccattcccatccttctgaaaaaacagtcttcaaacaccacggctagtgtccaaggctacttagctcagctggttggggtgctgggctactaaaatttcactgtagcatttcctgaattcttactaggctcatatattaacaccttcaacaaatatttgtgtgtcagcctctatgctgagggctggggatacagctatgaacaaggctgtgaactaagtactgtttctttaccagtgaattcttccatttcatgggcctctgattctggccctagtcagatatttctcaaatgcctgacgttgtttccaaaggggtacattcggagtagctagatcacagcaaacgcttcaagagttctcaacaataggtcagtggaaccttgatattctaaggacataatgatctaatttagactgaaaatcatctagccaaacacacactaggcatttaattcatgtaaggctcaatcagaatgtcagtatgaaccagataggacagagtgttcatttgcagagaacaatatcccggcttgcctgggcggctgcaaagcctttaaactgaaatccttgcttccactcttgctctgcacagcagccaaagaattttatcaaccctccaccggcttcctgttgcaattcgaataaaattccatctccttaccaggatctacgcagccctggagtctggcccctggttgtatctctggaagctggtcctggccttggagttgacctgaaactctttcccgcctcatcttttctcgcctggctcctcattatgcagagctttgttcaaatacaaagctctccttcccagggaggtccttcctggccagtctttctgtagcagttctggaccttccccacggcatctctttatgtccttagcgtatttcttattcttcatagtgggaatattatagcaatttatagcaataaatgtttgttgagtgaattaatatgcatcacacttactaaacacccaaaggttttctggggatgtctatgactattaccagatggccaatggtttgcggcactttatttttatatttttttacagcccacccataggagatgacagtactttattttattttatttttattttaagagacagggtctcactgtgttatccaggctagtctcgaactcctgggctcaagcagtcttacctcagctgcccaaagtgtcaccaggctggagtgcagtggcacgatctcggctcactgcaacctcagtgaggtgtgagccaccacttttaaaacgggcctgacagcactttttaaaatcatatttgaaaacctggtacttgacacagagccctagaacctactattaacaaagtgcttaatattgttgttgttgttgttaaattgattctaactaaattaacaccagaccagtgactggaaaaatcacatgtgaccaaagaatcccattgatggtgtcagacaatgacccaggaagaggagttcatagcggctgcttgtttccttactggaaatgcagggtgacagcagaactcagggaacatggtgctacccagtaaaagaaacagtgcataggccgggtgcggtggctcatacctgtaatcccagctctttgggagcccgaggcgggcggatcacctgaggtcaggagttcaagaccagcctggccaatgtggtgaaaccccatctctactaaaatacaaaaattagccgggcatgatggcgagtgcctgtaatcccagctattcgggaggctggagactcgcttgaatccgggaggcggaggctgcagtgagctgagatcacgccactgcactccagcctggtgacagagcgagactccgtctcaaaaaaaaaagaaagaaagaaagaaagaaacagtgcataacaggggcagggctgtttgcaatgtgatgaaagcataatggtgctgcagtcctgggcctgatgtcatcttgagactggatgttggtaggatggtgcccttctgtaatatgtttagtagctgcacttgctgaattgacagcctctctgtttaaaactgacaaggagaaaattaaagtttcccctgcttttcatgtcatgcatgaataaccaattgcttggcagctagttaaaattcatatttctcttgtcaggtttttagagactgtgaagatcaggttaatgtaagccttccctccttttgccctcttggctaactagctagttatatttgcatttctttttatataaatcttttttttttcctgtccctttgacagcacagtatcagagatggcatattatcttcagatgtgccatgctggaaagcgtttgctcttatataaatatagaggcagaaagagactgtctttcttcgcacgtatccaatccttttaggtatccaatccttttaatgactccaagtcaaaggttgttttttctcaccaacaaaaaggatttgtcaactaccaggaatctgagagttttctaatcctactggggtgggaagttctaaacattgtgacatagacttttctatttgtatagagtcactcacagatcctacaccatgcaattgtatcattgcctcatggaaaagaagacgctcttcaactttaacatgtttttgacacctgctaaacacctggtaatgctagctttctactcaggtctcttctcagctctcttctcagctctacagattataaatctttaatgctgacaaaggagttatcctgctgctgccagaaagaagctacacaaattttgcgatgctgtgaggcaaggcacaaatctcagaactgtggaaaacagagaatctttcccttcttcagttgtgtcttcttgccacaacttccatagaatcgcagctgagagtcactggcagctgtagccacatcttctctccaaatcacagagaaataactgagcggggaattaagagttgtctctgggttgcacaaacaatgtctcaggaacacgctggccaccactctgtatgaggaatgagaactggagcgcaggatatgaatttttctcaccctcaaaaaacccaggagagataccctcctaaggtttataggaaatttgttcctgacccaagggtcagagaatagcttactatgaattttaattggctcccaagtaattgctaattcatctctgactttggcaggaaaaaaaaattaaatgttaaagaaatgaatttagcaggaagacttttttcccttcttttcttttcttttttatatgagcacggtcctacagctgttgaagcctaacagagaagatggtaaataaacatgcagggctaggggcgttcatttgcagaactttctgcttgaagaggagcctggaaaactgcaggactcatttgggattacaaatctttttttttttttttttttttttttttttttgagacagggccttactctgtcacccaggctggagtgcaatggtgctatctcagctcactacaacctctgcctcccaagttcaagtgattctcccacctcagcctcctgagtagctgggattacaggcacatgccaccatgcccagctagttttagtatttttagtagagatggggttctgccatgttggccaggctggtctcgaactcctgacttcaggtgatccatccgcctcggtatcccaaagtgctgagattacaggcgtgagccactgcgccgggcctggattataaatctttaatgctgacaaaggagttatcctgctactgccagaaagaagctacacaaattttgtgatgctgtgaggcaaggcacagtgggtgcgagatgcagaagggacaggacacaggagggcctgtccccaccatgcaagtcacatgaaaccaaaaccaacctaacttgggtttgagaaactaaagtcccaggtgttggactcacctcttgtccttgtggacttcagaggatccgtctttgtccctaccctttcctctcatttcctccctccccaatttttttccctgacatttctctgctcaaactcacattttctcttatttgatgtctgctacatatataacatacaacatgttttaaaatgtatagttgaatcatcaaacattgagcattctttctgggaatttatgctgcctggcagataacgtccatctgttcactcgccattcattgccagtcacctgtgcccttgtctttctctgttgtggaggctaaagagagaaattttcaacttccccaattgcccatggctaggtggaacccgaggagtctggttcctgcttaaatcccatgtgtggctgggcacggtggctcacgaccgtaatcccagcactttaggaggccgaggcgggaggatcacctgaggtcaggagtttgagaccagcctggccaatatggtgaaaccctgtctctactaaaaatacaaaaatcagcttgggcgtggtacgggcgcctgtaatcccagctactcgggaggttgaggcagaaggatcgcttgaacccgggaggcggagctttcagtaagccaagatcgcgccactgcactccagcctgggtgacagaacgagactccgtctccaacaaacaaaaacaaaaacaaaacaacaacaacaacaaaaccaaacccatgtgtgatttttttcaggcctgaccgactgctattccagaggcatcacccgtcaggcctcaccggaaggctgcacagccggtgccacctcagagagtctctggcaagaggtcagcctcctctggctgctcctgcccttttgtggatctgctttcctagtccaggtgctctgttcggagggctcagggacccttaagggaagacacctttcttcactctgactcagtacttttacactctcagctttttcccctctcactacccaactccccagcccctggtccacaacccttcaggaagcctttggttaggggccccctcaagagtgagatgacccccacatctgtgctgatcctcctgaccctgaaccgtatgggtgcattgttccaaggggaaaatgaagcaggagagctcagcactccctccagtgttagcctcttgcttgtactactgcagtgcgggattaaagtcttcgctattacttccatttgtgcttgttgtagcttcaagtggctactctaacacctgacagctcagctcccttccagctctactgagctcctgacagcgccatgcgatgcaatttaatctaagaggaattcagccgcatggttataccggggcacggtggagaataaatgacattctgcctttgttctgcctaaaatacaggtgtgatgactggagatgcagaagccattccattatatcaacataacatgataagccaagaccctaaagatgctgagaaaaatggtcaaaagagcttggggtttttttggtttttttgtttgtttgttttgttttttttgaggcagtggtctcactgtgttgcccaagctggtctcaaactcctggcctcaggcttcagcctctcaaaactgctaggattacaagtgtgagccactgcatgagactgggctgttttttgtttggtttggtttttttagagacagggtcttgctctgtcacccaggctaaaatgtagggatgtgatcatagctcactgcagcctcaacctccttggctcaagtgatcctcccacctcagcctcccaagtagctgggaatacagacatgcactaccacacccagctaattaaaaaaacaaagtttagtagagacggaggtctccctatgttgcccaggctggtctcgaactcctcacctcaagtaatcctcctaccttggcctcccaaattgttggaattacaagcgtgagccaccatgcccagtactgtctggtttcttaataacattgttgagccattgcaatagccttgggatattgctctttgtactttttcttatgcaagaaaaacagattcacaagttatttgatgactctcttcccatcaaaaggaaaagtctaattctttttcccttgattatggatcagcttgagcttgttgcttctaacaaatggaagagagcaacatgctggagtgatcacatggaggaagcacaaagggatacatgcccaaggggccccagctgttccagcccctagacatttgaatctactcaggcaccaagtaagcaggtgaatagccttcaggtgattgcggcccactcccagctgaagccaagtggagcgcagatgagcttcccctgctgagccctgcccaaattgcagatttggaagcaaaatgaatattgttttaagccacaaatttgtgagtgttttgttacatagtataaggagccagaacagctctacagatgtaaattatagtcagatatgttgctatttataaccaaagcattcctaacttataaatgtttcaacattaataagcagaagaaagtgtaataatcttatcaaggtaatacaagttacttgtttaatataaccaccttcatggcaagcctcaatttcataacctaatcactttgagtacaacttggacctaatgggtagctttttttttttttttttttttgagacagggtcttgctctgtcacccaggatggagtacagtgacacaatcatggctcagcacagtctcaaactcctgggctgaaatgatcctcctacctcagcatcctgagtagctgggactaaaggcaggccccactatgcccagctaatttataatttttttttttttctgtagagatggagccttgctatgttgcccaggctgatcttgagctcctgggctcaagcagtcctccagctcaacatccccaagtattgggattataggcatgaaccaccactcttggcctctgtgtagcattttatagaaaatataaagttgatattataaattttatattaacagatttctataattaaaaatcttggctagattgtttttcctttactctttttttttgagatggagtttcactcttgttgcccaggctggagtgcaatggcaccatctcggctcacttcaacctctgcctcccgggttcaagtgattttcttgcctcagcctcctgagtagctgggattacaggcatgcaccaccacgcctggctaattttgtatttttagtagagatggggtttctccatgttggtcaggctggtctcgaactcccaacctcaggtgatccgcccgcctcagcctcccaaagtgctgggattacaggcatgagccaccatgcctggcctcctctactctttcattagtagagttaatatccattcattgcgcacttgctatgtgctaggtgctaaggacacaatagtgaacaagattaatcacctgagatccttgtcctaatgaagcttaccttctgggggggaaaacatgataaaaatgcagacaagtatgttaatataataatttcagatcataatgtgaagaaattagtgtgggatatgtgggggagatggggaatagatagttttgctttagttaaaatgtcagggaaggcatctctaaagaagaaacatcagagatgagacctggatgatgaagggagccagccatgggaagttctggggtagaagtgcttcagactaagggaatagccagtgcaaagagcctgtagccagaataaggttggtagagtccagaacagaaattaaaaaaaagtggggacagagggtggggtgggggagatggtactaagtgagagaaggggagcagacaggacccatatcccttaggtccttgtaggccatagtaaagaatctggaagttatttctgtaagtgcaatgttaaaggtactgacaggatatgctttgcacttttaaaagatcacactatggagaatggagtgcagaggggcaagagttgaagcaaggagacccattagaaggctgtggcagtaatcaagaagagatgattacggcttgattacacattggcaatggaggtggtgaggagctctgagatctgggataaattgagacagagcttgaaagagagctgatagaaattgccaatagagtgctgacggatttccacgtcgactggaaaggcaaattattaatttatgtgaatctcaatggttttgtcatcatttgagtgtaccatccggttgtcccctgagcctacgtgtatggtatttggaggataaatagaaggagcacaaggatgcagacactaagagtttaaagctgaagccaggcatgtcctgtgcattatttcaagcaggtgttgttaattaatgcccctctctggctgtatggcaacaagctgtagagcctccttctggggccatccctctagctctcagttccttttgttccaaatcagagcactagggtttgagttacttaggatctcacatgaatcattcttggggaactaggggcagggtaatgaatgctactaattagcctgctaagtatcctctgtaactagaggatatttggttgcaactagaaagctgaggtaattatctctttattatgtacgaatcttatttacatgagccacatgggcatttatgaccgattagctcagataaatggacatccaggctaatgacaacatcacaaattcattccctgtagaatccttctgttttagggctgtaaactctattccttgtagtatgaggtggccagcaagtctggaaacatagataatactatttttattatgtacgatttataacccattcattatgcttttccctgtgtttcaagaatttggtggccaccctggagacacttcttggggtatctttaccaaaactcaacataccagctctcaaaccattctacctttctgagacgcaccccatccacagaagtgggcttccagggactctgcccatgtgagtgactcacctagctggcctcaggtgattggacagagctgaacacttgtttcaagcagggccaatcagattccttctcccagaaggaagaaatggagagacaggcacacggtctctgtgaatgagagaacaatcacctctaaacttgttgctgtggttcagccatattcagccttgtggataaagaagcagagaaagcaggactctagtgtcagagaatgagctagatgtgcaaaaaaagtggaggaaagatgaaccaagggtgcatcttgggaatgcggatgctttttcgttctcaactttgcccttcctaaggtctggctgtactcctgcgtttggttcctcaacacacttttgtatatgtataccaaattccccctttgtgcctaagtggagtccttttggtttctgtcacttgccgcccaagagtcttaactaatatgactttagatcttgtccacactctccccagggaattccattggtcataagggtcaggaaggaatacatagataagtatgaatccattgtcactgaagtggaaacaatttaagagcagtctcttctagaatgataccaatactatcatctgtaaacacaaatgccagttgcatcccgtcctgcagagcaaggaaaaatcctctttctattccagaattgacttttttctattagaaaagagtttccctaaggtactgacagaagaatctgctctttgaaaaacaatttcaaatccttatacgccagcagatctgcactaaatgaaaagttgccctcagatatccatggctgcaatgtcctcagaaattgtttgcaccgtcctttaccaaaacgaactctatcaagtataaccaaatagacttgctttcccggtcttggttctatgtacaatgccaccaaactgcattttatttgatgaaaaaggtgatgtttccagtttcaaatggttagcaaaaagtaggggaattaaggcttcttattttagtgtaatgtgccttcttgtgtttagatggtaacttcataagggcgagcaaagagtatccccccaaaatggtaaaatactttaaatataacaagaaacacaagacataaggaaagtaaaagtctaggctgggcacagtgactcacacctataatcccagcactttgggaggctgaggcaggaggatcacttgaagtcagaagttggagtccatccggggcaacatagcgagaccccatctctacaaaaataaaaaattagctgggtgtggtcacatgcaacttttgtcctagctggttgggaccctaaggcaggaggatctctcgagcccaggagttcaagtttgcagtgagctatgatcgcaccactgcactccagcctgggcaacagagctaaactctgtctccaaaaataaataaataagctatattttttaaacaagaaaaaaattaaaaaggctaacaacccaaatagcacaaccagaggcagtgggtgtggggcagatcagtaggcaaattccttgagggcaagggccctttgccccagagccaagcactttgcctggaatagaacaggaaataaatgtttacagagtaaaccgattgtatgaacacatgattgaaagtattgataaaatgaaagccagaaaactatattacccattgctaataggacacaaattggttgctgtcaaatttaaagtattaaatactcttgaatttgtccacgcaattgaatctgatatagcctctggatataaaaagtaagattctaaaagctcatcaggctcccctagttactgcttttttttttttttttttttt

SEQ ID NO: 37 - DNA, 13854 bp, Homo sapiens
agtgatccgcccgcctccgcctcccaaagtgctgggattacaggtgtgagccactgcgcctggccgctgctcttatactattttgaatgtaggccggccgtagtggctcacacctgtaatctcagcactttgggaggccgaggcaggtggatcacctgaggtcagaagtttgaggctggttttagtagagacgaaaccccgtctctactaaaaatacaaaaattagctgggtgtggtggtgggcacctgtaatctcagctactcaggaggccaaggcaggagaatctcttgaacctgggaggcagaggttgcagtgagctttgatcatgccattgcactccagcctgggtgacagagcgaaactccatctcaaaaaaaattttttttaaagaatatagatataagccacaacccgaggaccccaacctccccactgcatatgtgaatagggagttcactatgaactctttctacgtgaccactcttgagaccttaatggctgctgtacttgggctgccgaactccataaaggacaagactgaaagattcacctccgacctggtgtttgcagcctgaggccagtcctgtcacaggtcacagggaatcactgccacccgttttaattacagtctctggaagaagaggccaaaccccttctgatttgcagaaagcctggtttctttatcttattaacaacaacatatcccagcgctccagtgattacagacccattcctgaagcaatcaaattgcctatttgaaagaaagactatttcctttccctaatgaatgtgaacagtcccccagagcctgaaggtatggctatgaatgccccactgtaacaatgaaaaactattataaataaatgacacagagctgctctgttcttaaaaatcaccacatgatcaatttgagagacatgcatgaagatgggactcaggagattttgttttaattattctgcccgaaggaaaacaatactttgctctttgctggcaccgctgtacagagaagcttaaagagactttgaaaacatgatcctgttcatccttctcaaatcacaggcagacacagttgccctcattttttgaaaggggaaactgaggtgtagacaaatgagtgttttctgtgtttagcaggctatttaaagactcatatatcatcatatccaacatgtttttatgtctctcccctactcagctgttctgatcattgtatttgaaaactcaccaaaaaggggagaaattaacaaaaggctatagagaaggtgagcttttacttttataagctgccaacttcttaaaataattttaaaatgaggtgtgtgcacgtgtgcctgtgtgtgcatgtgtgcgcacacacatacatacacatgtttgagtatgccttggtattggggtcaggaaatagtaaggatagaaagataggaagaagtgagggcacttcattgcagccaccaaacccaggagtacctgcccctccccgaaggctgcagcctattagccagagggcctgggatatagccagcgactggggctggattagcgaggttgatgaaaaattatgtactttatagttctgtcagaccagggtacccttggaataaaatcttttagaatttgaaaaaatatccacttactagtgaatacaggacccccatctgagacctactgctgcccaggatggcagtttataattaatatttcatcaggggtcaaactgcagaccaccaagaagaccctgtgagactgtattgaaaaatcaacttgttaccctttgccattttttaaaaaagaaaaaagtgaatccatttgaaattcatagataggagtctgcgactgcaaaatgtccaataagattaactaaaaattcctcaggagcctgaatatttatatttccagggattctttactgtagtatcagtacttcttagaagggtttgttgtttgtggatggcaagtgcctttgcactgcttctttgtacaattcttagccacatgactttcctcaggagttgacagaatcccccacccccccaaaaaaattcagaggagccttatttttgcttacttttaaaggaagagaacacaagttattttaaaaggtttctggaatttggctatctagatggtttgacagtgttaagtgaatcaactaatcacattgaccaaatcactggctaattcagtaaagcaatcagcttaactaattgtccaactgatgatcaaatcaatgaaccggtcttgttttggatcttttgtttttcgtttgctttgttcttgacattgggtaggcacagctcaagttgtgcaagccagacattctcaccaatacttataggaaagaagtggacaatatacttaaaaatgtgagaatccgtatggaaaacagaacttcattaaagaattagatggaattaaatgggttaagctcatcagaaaaaaaaaaaaaattaaaggaaaaggctattcttaccagggaatgaagtctctgcagaaattgattatgtagagagtccctttgggtcttggaacaattagctctcagaaaattagaggatagcctttggcttctggggattcgaatgtaacaggtgtctgctgtcccttaggaaattcttcactccttctagctgctcattttttggctgcctgcccctgcagggtaaacccaaacccctgagagttaaagattttgagtcatagagaacctgaataattggattctcggagggcattacttttgcaagattccgccacagatgtacttctggggtgttttctgtgatagaaaaaagaaatcccttctcctactgagaaaagacaacaactaagaggccgtatttcctacagtgggtaacggagaggagacaatatttgtttctgtccctgtactaacctcattcttaggacagcatgaacactgggggaggtgactaggcctccgtctttcagatacctgagaaaagtgaaacgtgatctctgtggtgattcaggtagagttattaggcatggacagaaagcagggagtgcacagatgcctttgtgcaaaggagagtgattttctcattttacctgctgagaaagagtagaggtatttatgccaggatgggtgttattaaacagatgaaggacaatctgacagagttaattaaggatcttgagtgtcaggatccagagaaagagatatctcgtgtaggaggcaggtatgggaaaggtaagtccgcaagggagggtgagtgcttttcccacaaaggggaggcagcacattcttgcttcagggtgaaggatacaacacattctgaaatgaggtttggaatattgtgtatttttagctgctgctgtgaaaattcctcctaaggagagagccatctttggggaaattgcctctccaagtctccctgggtaggggctgagcctccagggtttggctaggccaaggcccagctctcagaggccagggtgaggtaaggctgcctgtagaggatggaacctgggaagaaggggaagaaagagatagaaaaaggcttccagagggacctgggtatgaaatgactgggtctacgcgggatgtgactcctctctctggctcttcaaatcttcataataatcaaactgacaacatgtttggtggaaatagattttttttttttaaaccagtgaagttgggcccctagagtagaacagagatacaatgtgtggaagtagggtctggagcagaggacctctaaaaccactatgtctgtgctagggacacaggaaccatagtgggccccacccaatatctgagtttcagagtaaaacaaaatgaggctttgagtgtgctgtattttaatatgtggttgcagagatcaacacgcagcaggagaaccactttgcaatataaaaatctgtctccaggctgggcgtggcggctcacgcctgtaatcccagtgagaggtgacagcgtgctggcagtcctcaaaaccctcgcttgctctcggcgcctcctctgcctgggttcccactttggccgcacttgaggagcccttcggcctgccgctgcactgtgggagcccctttctgggctggccaaggccagagccggctccctcagcttgcagggaggtgtggagggagaggcacgagcgggaaccagggctgtgcgcagcgcttgcgggccagctggagttccgggtgggcgtgggcttggctggccctgcactctgagcggccagctggccctgccggccccgggcagtgaggggcttagcacccgggccagcggctgcggagggtgtactgggtcccccagcagtgccagccgaccggcgctgtgctcgatttctcacccagccttagctgccttcccgcggggcagggctcgggacctgcagcccaccatgcctgagcctcccacccactccatgggctcctgtgcggcccgagcctccctgacgagcaccaccccctgctccatggcgcccagtcccatcgaccacccaagggctgaggaatgcgagcgcacgcgcaggactggcaggcagctccacctgcagcccggatgtgggatccactaggtgaagccagctgggctcctgagtctggtggggatgtggacagtctttatgtctagctcagggattgtaaatacaccaatcagcaccctgtgtttagctcaaggtttgtgagtgcaccaatggacactctgttatctagctgctctggtggggccttggagaacctttatgtctagctcagggattgtaaacacaccaatcagcaccctgtgtctagctcagggtttgtgagtgcaccaatcgacactctgtatctagctgctctggtggggccttggagaacctttatgtctagctcagggattgtaaatacaccaatcagcactctgtatctagctcaaggtttgtaaacacaccaatcagcaccctgtgtttagctcaaggtttgtgaatgcaccaatcgacactctgtatctagctgctctgctggggccttggagaacctttgtgtccatactctgtatctaactaatctgatggggacgtggagaacctttgtatctagcccagggattgtaaatgcaccaatcagcaccctgtcaaaacaggccactcggctctaccaatcagcaggatgtgggtggggccagataagagactaaaagcaggctgcccgagccagcattggtaacccgcttggatccccttccacactgtggaagcattgttttttcactctgcaatgaatcttgctactgctcactctttgggtccacgctgcttttatgagctgtaacactcaccgcgaagatctgcagcttcactcctgagcccagggagaccatgagcccaccgggatgaatgaacaaccccagacgtgctgccttaagagctgtaacactcaccgtgaaggtctgcagcttcactcctgagccagcgagaccacgaacccaccagaaggaagaaactctgaacacatctgaacatcagaagggacagactccagacgcgccaccttaagagctgtaacactcaccacgagggtccgcggcttcattcttgaagtcagtgagaccaagaacccaccaattccggacacaccagcactctgggaggccaaggtgggaggatcacctgaggtcaggagtgcgagaccagcctggccaacatggtaaaccccgtttctactactaaaaataccaaaattagtggggcttggtggcgggtgcctgtaatcccagctacttcggaggctgaggcaggagaatcacttgaacctgggaggcagaggctgcagtgagccactgcattccagcctgggcaacaagagcaaaactctgtctcaaaaaaaaaaaaaaaatcttgagtggtgattcttacttaagtgcacacattggcacttctttattttgagggaactgtggtagtatctatcaaaacttaaactaggaacaacctccaactcaataactgccttatagaaacactcaaatatgtgtatacttcaaggaaactgccttatagaaatgctcaaatatgtgtacaaacacataagtgcaaggaagttgttttgaagcataaattgtaagagcaaaaccttggaaataacctgattgtccataaatagggaaatagtcaaactgattattatacgattatgtaatcttcagtatactaatttttttttaattggggcaaaattcacataacataaaattaaccacaaaccatttttaagtgtacaatttagtggcatttaatacattcatagtgtgcaactgagacagccaaatgcttaggcagataagaaggggtccccagagaatctccaacctgccccacaagtgtttacatcggatgctttcgtgcagatgagggactctgcccaaagctttgtctgggcatgcccacagtggactggagctccacatgcgcactgggggaagtgggtggagccatggggaattggcaccctacacaggggaggagcctgctctcccaggttcctgtgtggtggccagggattcagtctgtgaggtggacggcatgttacaggtctccatctcactttgctgagtgttttttttttctttttttcctttttgcccaataaagtcctgctctactcacccttcaatgtgtccgtgtgcctaaattttcctggtcgtgtgacaagaacctgagatttagctgaactaaggagtaaggttctacaatacaaccatcacctctctttaattccaggacggtgttatcactccaaaagggagcctcatacacattaagcagtcactcctcatcacccttgagaaatgatttcttgaatttttgagacagggtcttgctttgttgcccaggctggagtgcagtggtgcaatgatggcttactgcagcctcaatcgttcaggctgaagcgatcctcccacttcagcctcccagagtagctggtattacaggtgtgtatcaccatgcccagctaatttatcaattttttgtacagatagggtcttactatgttgtccaagctggtcttgaactcctggcctcaagccaggagtttcccaaagtgctaggactacaggtgtgagccaccatacctggctgagaaaagattttaaatgtcagaatagtatgaacagtgtcaccctatatatgtatgaaaaccctctaaactatgtcctatgtttccgtctactgacagaggcattgcagaatagtggttctaggcagagctccagaaccaggccgcctggctttcaaatcctggccctgacacagaccagctgtgcatcactgggggtgtgtttagcctatctgtgcctctgtttccacaggtgtaaattgggcatagttgtgaagaggaaatcagtaaggacaagcctaatacagtcactgtttagtatacttacttctgtgtttgaagttttctttttaaagtcaaaatcatgggcaaataaacctattgccagtgtagaacacacattcctagactactccctttcaggacaccaggtgagggctaccccccatcagtgcttgcctcttgcttaaagctaaggctgcagggaggatgcatattttcacgccagcacagagcacactttaaatctcctcaacagcgtggcagaaatgcaggctttaaagagcaacaaaatcctgactgacaagattcaagggaagtacctgatcagggaagtacaagtacaagattcagggaagtaactgaaaaatgtaagttttaagacttacatttgactcaagggccagcaggcatttcagacagcaagagggagggtctctgtgaaggtgagatacccaaagaagaaggaacagagggaagaaggaaggaaaaggaagaaggaagaggggaaggaatggagaaaagaagaaaaggaagaagggagagaaggaggaaggaaggagaaaggaagggaggaaggaagaaggaaagaagggaaggaggaaagggagaagaaagggaggaacaaaggaagagggtaagaaaaaggaagaaaggaaagaggagagagagggaataaggaaggaagaggaaaagaaaaaagggttaaaaaataagttaggatgaaggaaaggaagaaaagagaaggtgaggaagtacaaggaaacaggtgagccccagccctgctgtgatttcagttctcagatctaaagtgttcaagtaaaaacaaagcacaggcatagccttctttttttttttttttctagatggagtctcgctctgtcacccaggctggagtgcagtggtgcgatctcagctcactgcaacctctgcctcccgggttcaagcgattcttctgcctcagtctccagagtagctgggactacaggtgtgcgccaccacacctggctaattttttgtatttttagtatttttagtagagatggggtttcaccatataggccaggctggtctcgaactcctgacctcgtgatctgcctgcctcagcttcctcaagtgctgggattacaggcatgagccaccgcgcctggccagcacaggcaaagcctttcaaccaaaaaatcaagggagaactaagagaagtatttgcgatttcaatttttttctactgagtcctaatctaaatggaggtcagaaactggacaatacaaagctgccatgcgtcaaggatggaacaagcacagccgcggccaagctcgcacattcctaggtgctttccaggatgcccctccagggtgcgtgcggtggcctccaggatgcccctccagggtgcgtgcggtggcctccaggatgcccctccagggtgcgtgtggtggcctccaggatgcccctccagggtgcgtgcggtgtcccagcccccagaggtgcctgcggaaactgttgcaagggtgatcccctgataaacctttcactttgtttctgaatcggaacacagccccaagcggacttggggctgctgggctgccaggggtttttaaatatttaacaaggtttggaggcagtgagcacaaagctcaggtccacccaatttcttagcagaaggtggaaatgcaagtatggaattgtcttgcagaaaaacgcagttttgaacttctgtcttttcaaagacaatattttaaaactcaaatgctacgaaactaccagataatgaggtagttagatggaattttgctagcatatatttgcaaatattttaagaatgctttgtatgcttctgttgacttaatgaagtgattgaaaagggttaagccgtgtttggtatcttcaaaatggcgattttgcttctgataactttccggaaaaattaaaggtgttgtgaaggataaattatagtttgatttgagtcgtcttgttaaaacgtcattcctctttctcagcaacctacttcccgtcttattaagccagttgactagataggtctaggcaattatgacgatgatttactatcttcatgctccattgtcactgggagccaagggatgggggaagggaattcacattcccatcttacgtgtctcttggagggacaatcaagtcctcagctgtagcgttaaacacagcaatagaaagcagagacacagtaaagcattttcactgctcttatgagctgagatataaaatgagatttatttgcaacaatctgatagagaaaattgagtcctgagaattgatgtcctagaaaggctttcaagtcagccaggagttactacaggacgtgagtcacacagcaaaatatcaaagagttggaggagaaaaaaaattgagctttgacattttctgcagccgctgttaaagaaattgaccaatgtgtacaatacgaattatggtcacaattacaatcttctccgatccagtctttcctaacagttggataccttggatccttagattgatgtcatcattcagctttttgcttttttaaaatattcagttctactgcagatgggatgctaaataaacaaaccccctaaatggctctctcctttccccccagaggtttaatccttataaataactccgaataattgtgatgtatcttctggcatttcacatattctgaaaattaccattgaaatttgaatttaatcatataataacccccaaatatattttaaactgagagtataaactagaagttttggtgtaatctcatttactcaggaattcatttagtggccactatttgtcatgattttaatgtgggtctgacattggtaggtcatgttcggagtgaagatatctgcagtttttcaatttgcataatccagttagtgcttccagaatgtcttccatgtctcttcatgtttgcaaattaccagaggtcacaggtaaaattttaaaacgtgagagttgttcatgaacatactcgggctttgtcaaaatcaggatatctcccttccctttgtagtttactttttttttttttttttttttttgataagtaatgggtctgaagcttcaggacacaagatgaccaaaaccagtttttctgctgggccctctgaattctacccaagataatgctacacatttatataacgcccacacctgcttatgctgcagtaattctttcaaaagttctagcaatttggactcctctttttatttaatttggggatttagtcgctaatctacagttacttctagaaataagcagatgactgcttcaaaaagcaaaaactttctgacaccttttattaccctctagatgaaaatgaggacggtaataactttcaaaggtaactgatacactcaatggtggctcaccacctcatttcagacaaccaggggggctcagtgcacagctgctcttttattctcttccaagagagtttgtgtaagaactttgcaagcatttcctttacaatttgtctttctgggaaaattgcatatggcgttggtataacttgcttaatagtcacaatttattaatttcatcattttttctcaagagaggtagaaaaaaatgactaatcgtgtggtgggtgacagagagtctttctttggaccataaaaggtaactggatcaagtccccaaacaatgttactgacttaaaaattcacatctgcactgtatttatagttaccttattttttgacccattgcttatgcttgaacaagactcttttttttttctttgagacagagtcttgctctgtcacccaggctgtaatacagtggcacaatcacggctcactgcagcctccatctgcagcctccatctcctggtctcaagcaatcctcccacctcagcctccctagttgctgggaccacaggctcatgccaccatgcccagctaaaaaacaaaactccccgcgccgcctcaccaaaaaaacaaaacaaaacaaggctcttaagttcaattttctaagtaaaaatttgtgaaactatttttgttgtttcattaccattcgtttctaagaccaaaggatacatattgttctctgctttcttctccctaaagccaaactttttttttctttctttctatggttacgtcacgttaattttttttttttgagacggagtctcgctctgtcacccaagccggagtgcagtcacacagtctcagctcactaaaagctccgcctcctgggttcaagcgactttcctgcctcagcctcctgagtagctggggcttcaggtgtgtgccactacacccagctaatttttgtatttttagtagagacagggttttactatgttagccaggctgctcttgaactcctgacctcatgatccgcccccctccacctcccaaagtgctgggattacaggcatgagccaccacgcccggccatgtcacgtaaattttaatgagacgaaatatctatcaagcttaaaatcatatgagaaatttgaaggaaaatgattgtagattttattcggaaaagatactctgagtcatcagttattcctttttttctgattattaaggctgataaaaaaaaacctctttattttgaaatatgtatgggctcacagaaagctgcaacacttaacacatagagttccatgtggtgacatcttatataaccatagtaccatattaaaaccagtaaactggcgtggaataacactagtaactagagtatagaccttactctgcattctccagtttttacatgcactcatgtgtgtgtgtatttatagttctatgcaatttgaccccagttatagatcagtacataattactgttgtagctaacacaacaattaggatacagaattgttccatcagcacaaaggaactccctcattctacccctttgcatcctccctctgtccgctgttcataatccctggccaccactaatctgttctccatctctacacttttgtcatttccaggatgttctataaatggagtcatacagtatgtaaccttttgacattgactttttcacccagcataatgtccttaagacccacccagtttgtcgcatgtatccatagtttattcctttgcgtggctgaatagtattccaccgtatggatatgccagagtttgcttaaccatttgccctttgaaagacatttggattgttcacagtttttttgctattacaaataaagctactatcagcattcatatacagacttattctctgtgtatatgagcataagttttcatttctctgggataaatgcccaagaggatatgattgctaggttatgtggcaaatgcagatttagttttatgaaaaactgtcaagaaattttccagagtagatgtacattttaaacttccaccagcagtataggaggggtccagttttcccacatcctcgccagtaacaaactttttagatgagtaagtgaacatgaaaacattgtgagatgacaaaggccacatatagactgggcaaagtatgtgaaaggagatatttggcttgtatatgatcctcagaccactttttcaggagagatggcagcaacatttgctgtaatataaatttcccctgcttttatcagcctgtagccatgaatcagcagtggcttcaagtgttagaaaactcaactacagccatttaagcacatggggctattttcctcacagaacaagagatgcagaaatcagcgactgcggaggcttaaagatgatggctgctgctgctgttgcttcaggaatcatgttcacattcctccaggaagaagacagaaggagaaaaggcagtgtttctatcacagaaaaaaaaattgtttttttttttttttcaggaacaccactagtgttctgttttggtcatgttgcccagaacactgcctcagatcccctcatggctggaacaacatggtagggagaagggccttggaatgctgactgggtcaggaattcactattatctgccacaggggaccgtcaacattaatggtcaacctttgccagcttaaggcttcccccagtgatgcatggcctcatcttattgtaatgtcctccatcgtaaagcatttctgggtatttctatggggtatctcacttgtgcttataagcaaagtccggtcccactgctcaacaccattgttctctgcaggtccttgtgaggtacaatgttatctgcagggccctcccctcccctaagcttccgccctggtcctctggttgtcaccatggaggaactagaaagttcacgcagttggggctgcattccttgccaaagtggggagagagctctcccccctgctttgggcactctttgtcatgctctgtgccatgcgtttcatgactacctttctgaacccatttcctcacttgagcttatgaacgttcactcttcattggttcatacattgtccatggggctggacaggtgaccagacacaaggccatccgttccactgataatgtctttctcattcttacattcccacaaa

SEQ ID NO: 38 - DNA, 346832 bp, Homo sapiens
agcagatggcatttgagcaaacacttgcaaaaggtgaggaagatagccatcatagctgatggaacaagcaaaacaaaagtcataaggaagaattgtactcgtgtgtttgaagacatcaaggaatccggggcgatagacatagcaagtgaggggagggtatgagaggaattgggtgggaggcacagtgggaggccagggcatttaagatgttgaggactttcggcttcatgcagcataactgagtatatttaagaaagaatgctcattgaatgttcccgttacaccatgcactgaggtaagcgctttatttatatttctctgtgatttttttggttagtcttcataagaaccctacgtacaaaatagtattattaatatctatattttattaacaagcatgtttagtcctaaagaagtcgattaactcacccaaggtcacatagatggtaaatgatgagaactgtatctaggctttccgacacctgtctgtttgatcatagcattatcctgagtccaagttgaatggcttctatttgattttgcaatgtcaaattacctgaaatgatgtagacatgcaattcaaagttccactgctgtgcaaagacttaattcttgctatgggctgaaagtttccattcccctcaaattaatgttatactgctaacccccaaagttgtggtattaggagctggggaatttggggaggtgatgaagtcattgggcagagtcctcatgagtaagattagtgcacttttaaaagaggcctaaaaaagactcctgctcacctcttccaccatgtgagggcacagcaagaaggtgccatcagtgaaccagaaagtgagcactcatgaggcatggaatctgccagtgccttgatctgggacttcccagcatccagggctgtacgaaagttctgtagtctgtgagccgtccagtttatggtattttgttatagcagcccaaatgctatatgtacttagcccatgtggactaagataattggtaagaggtcttcacactttctcagctaccagaaagtacatttgaattcaactgaggaaatctatttagtcattgttttgccatgttacccccacccaacaagcatttgttatgttttcatgttgcaagttggattcttggagaggcctttgggatcaacccttgtgaaaaggagagaagagaaaggggaataggcagaagaggaatgagctgtgatggaggcccactgatggcctcagctgatctcaccagaagcttggcactctggtggctctcagcaagactttattcccttacatcaatccatcattggttgtgggcctctgaaggagtattgaggcacaacaccttacagcatccaccacaatctgtagcatcaaaatgctttctgattacttgagttgccctgggtgctacaagggaaatacaagcagactctaagtgtggttttattgatgttgaagtagcttcctttcatggaaaaagaggcaaaaacctcgacatttcccctatttccccttctggtgtacagaaatgcatttggtgtggatctataaatttaaagctaataagatttctattctactgatgctataactgtttgataatctaaaaagattctcaaatgatttttgtggtggggataacctagatttgtgaaggtgcacatatgggtttgtgagtgtgtgttttaaacatataatagaaatagaagagagataacataaggaaatgtgtcacttttcccaatttttcattctcatgaatgctcacttcttcctttcgctttcatggttgctgagggttatttgctggcgggacaatagtccctgtgtcaaagggctggtgggtcaactcaccaagctaagctgctgctgacagatgagtgatggaaagatgtactgttgtatctgtcagctctgatgagaaaaagtggagcttagcttagaatcattctcatttccagatttttatttgtattgttattttattcctgaaaagaggattgatttctttctgcattatgtaggtctctttttcaatgctcccgggtaaaccaatctcaaagcacaaagactgaaattcctctactttccacagtttgtaggcaacgaatttagaatgtgtctcatcaccactttattcttctcatcacctcgaaaagtgactagcagaattcccacttggtttataataaaagaaagcaacaatttcatctacgaattagcatactagtatgaatgcgcactcttgaaaataaatgtgctattttgtatagtcttgtttcctgagagagcagtgacttgcatttttatataaacatgctgaattttacgtgtgtttagaaaaatttggcatacatatttccagaatactgaaaatctgacaaacccttgtgccctactgttgttacccaacgttccttctctgggaactgcctattaaaaaatcctgcagattgtctcccatcccttattaaaatgtgcaggaaataagcctaactgttaagtgtatgaaggtcttgaaaaccatactctgctggctattgtcattgacattaaactccctaaaatattctaaaacaaggacattcaagttaaccttacttcattatttaacactaaagaaggcaacatggattctccaatctctgagattgttaggagataagatcttccagaaccttatcactcaatcacagaatcaaagaatgtgctcagctaagacacattgattgacaaatcctttatgcatatgagtgacaatgtcagctttcaggaagcagagaaaagatgaagaaaaataaaatctctagatgactcacaattaactaggacaaattttctggacatacagagttcataggtaccttgggaggcgtttataatgtttgcccgttaattgaagcatttatttatttaataatcaaacatttattgaatgcctatggggatccaggatttaaagatacagagcttaaaaactgagaccttgcctctgctatagggatttacagaaaaagaaatgaatttataatgcaatagaacgaaggcatctctggaagcacgctcaggaatatggaaggatatgggctggaaaccaaacccaaatagcagacatggaggaagatgttttgttttttcttcaggaattccacgtgacttcatataagcttgaaatatgagtatggataggccaggaggcccaggaacagggattggtgaagtggtagtgatggtgggttggggttacataaaggagagaaaggacagcacattcggagtcaccaaggggcaggattgagaaactgcaagcaattcaagatggcgggaatagaactgatgaggctagaaataaagaggttgatctataagaggaggacaagggccagatcgaggccttataagccctgctaaggaatttgaattttatcatgaaggcaatagggacccagtgaaggctaagtagggagatcctatggacatttctgctttagagctgggagttacacacaggggttttaaatccattagggccatgaaattagatattcagaccggtatattttcttaatgaaatagaatcaattataataaaaaggaaatcttaaaatacattgcaagtagtaatagtaattaatttgttttatacaatttgtgtagtaggtcacaaagtaagtttttgttactgagggtgtggccaaaataatttgagaagcagtaatttagaaagatctttcaggcagctgaaagcagggagagcagttaaaagattattcctagaaccatattatacaagaggagagaagtgggtcctgcagaatcatgggaagatgggaggacacgtcatttcattcctgtgatgtctctgaggtgactaaagcctccagactctgcatttcatagattgcaacatgagacatggatgcctatgacctctcaaaggaagggcttccaccatgtttgcagtgctgctttgctgttccctccacctcagatgatagtgcttcatttctacatgaaaggtccattattcgaaagacagcttaaagtgttgcattttccatgaaatttcctcagatctccctatctagaaataacctagcatcaatcctttcttccactgtattagtcatttgtgtagcatgccccataaatcccttcttgctgcatccacctgttgaatggtcttcagaataatcaacactatttgaaaagtgcttacaagtgtctttgcatttcttccttctcttccctcttctagaatgtgagacacttgagggcaggagtggaactgtcttcttcactatttcaagggccaggaaagggagtgacattgagaagagactgaataaaaagttattaaatgaaggaatggatttaaaagcaccctgatctgcagtgtacctgaaacagcatatacttcatatcacaactgtagtatcttcatccttgctcatgttttttccactgcactaaagtgcttctttaaatagaagaatcaaaatagtgggattcaatgataagtagatgctattttgaaattttattttgattagaaatggattgcagtaatatttttactttctgtggaatggttatgtacataataaatactctgcctgcattgtatttgcaaaacatcgatgtctttgattttgtggctttagaaagtttttcaaatacaaattcaatctgccattgtttgtgtgagttggggaaagaagggcccacacattttggagcttcccaaatggacatgttggcaatgattccatgagtcctgtctctgaagtctttgggaaggtctccaacctcctgcccacttatttttttccttgtttatttttatggaggaagccaaaatcaagttaaggatatttaattataggctgtggctttctttagaattaaaataatcagtgatatattaccattttgccaaacatctcatgatgctcttgtttttaaggatgacaataatttttaatttaaaatgcaaacaaacctgctgcttagccctttgtgctttacctgttgagagtatttggaaatctgacattggaaggcttgtgttacctttcatcaggttcaacaaggcagtagcaacataaagaaaaccctggggagtcagactcatgatacactcataggcttatttagcgttaagatacaaatatctaggatgtgaagtccacgctaatggttgatggaagaatttaaattattgctataacctgaccatgcacaattgtctaactcttactttggattgattgcttatatgtgatgtcataatgtggttaagaaaggcaaaaatttactgaaatcaaaatacctggattgtaattgccgttctgctataagttagttgtgcaataattagaggattctaaaacaaagctataacagcaacaacaaatatagacaaatgtagttgaattcaaggaattatagacaaatttaaaatcaaattctactttcagcacttaccatttttgttagattgagcaaggccctgcacctctcagagcctcagttttctcatttgtgaaaaatggtgcatcacgagcttatcagaattcactgagttgtgttattgaaatgcctaggaaaaatgctggggatattatttttttgtataactaaactcaggtgaactgaagcactgctggagctgttttgggagaaagtgaccaagatctagaagaggtgggaaaagagtcttgaacaaagagtacttggaggatgaaattcagtaattcaaacttaaaataattcagacgtaaagctgttggaactttattctgaggaatgtggctgtgaagcctgagtcgcatggcatgcggatgcaacttccgtcttttttctgtaaacattcaggaccaaatagtgccaaagaaaagacacctcccccacctcagattatcctcctcatggagtaataaagtcctcttccttgtagctaatcaaatcactggggtgtttgcactggtcttgtataaaaaatataatcctgctaaaatttctatgtaaaggaaaccataccttctctactttggaatgctggccccattcctttggagtcgatgtttctgggtggcccgcctcaaactttgcctcaaagaaactgtatacttaatcatattttctgaatctcattatttaaagttgacaggaggaactgggaagttcacagtggagaagagaagggagcatattaaaaagagaagtgggttgagagttggaaatatgatttatccactcagcactgccactaaatatgtatgccatgggaggctggtgactgtcctattctggaccaatttttcttggcttaaaaaatgagaaagttgaagtggatgacctttgaagtctctcactgctttcacaatcacttgagtctgaggataaaccgagcagctacttgcacatttttaaaagtattaatatatggtaggaggaatagacttattcagtgctgctatggaaggcagaacaagtcgtgaaagttatattgagaaagaatatttgcttaacataaaaaagggcctctcaaaaaattagaattatttaatgatagaaaagctgccttagaaggtggtaagctccaatgttgagattttaagtctctgtatttcctctaaatatttagaatattcttcctttcactttttcactaagccggttcatattaagatacaaccaacttatcacctttttgggggaaacttcctagggtttctctgtctggtaaaatcatcccctttcttttccctcagacttttgtgcttatctctattttgggggcctatttgggggcaaaaatttgtcatgatgagaaattgaaacctctccaaaatggaagaatacttgaaaaattatgggatagccatgtgataaaatacttcacaatcatttaaaattttgttcatgaaaagattgttttgaaatacaaaattatgttattttataatgctacctgagaaaagaaaggtacaaattgtatatttaagtatagtcttcttttttttttttttaaacgttgtttcactcttattgcccaggctggcatgcaatggtgcaatctcggctcactgcaacctccgtctcccaggttcaatcagttctccggcctcagcctcctgagcagctgggattacaggcatgcgccaccatgcctggctaattttttgtatttttagtatagacggggtttctccacgttggtcaggctggtctcaaactcccaacctcaggtgatccacctgccttggcctcccaaagtgctgggattataggcgtgaaccactgcacctggcctaactccaactgttttaaatgtgcttataaacacttgaatagaagggtatatatattaaaatactcattttgaaagtgggcaaatctttacaggcaaatatttattattttatctacatttttctttattttcttatgttctcaagtgagcatgtctgcttttataatataaaaattgttaaaatagaaaaacaataacttgtattttgaaaaccaagaaaatagttgatattcaattacctggatttctggattgggttttgtgctgtcacaaattgtgccgtcacaaatgacacacatgacacacaaataacacaaatgacacaaatgacacaaaactgtcatgcacaattcctgatgaataatctttttattttgcaagcatcttttgtccttcatcctcatccagtatccagcatcacaggccaccgcaggaaagctgaggccccgtggacaatgaaaccacataaactgagctcagagaaatgcagcttgatgaaataaagtagttgaaatggaaaaatagttccctatattcttcctgattccttcaggttacctgctccaactatggctaaagtgctggagagttttgattgccagccacttcttgatcatttctttgagtctctattctttcctggtttaagcttttaaccctatccttccagagctcctggcatgaaaggggctaaggtcctagtgatcgtaatacaacaaaactctgatgttgactccagggagggaaagaattcaacatcaatgtgctatataatccaaagaaaggatttggttttattgtgagcaggtgactcaagtcaggtgcctgcaataagctagaaaaaggcaactttgtgaaagttatcaagctgttaatctagtttaatctcctcaaccagcaaacattgggaaagagcatacaatattccaggctcagtgctaggcatttagggtaacataaaggtaaagaaatctcaaggtactcatcagggatggcagcaagcagagatgtgaagaaacaattacgatgctgagccataggcacaactctacacattatccacagtgtatacacattatacacatacatgtgcatgtgactgtgtcttccaacttaggcggacatgaacaatgagaaaaagagttttaagactgaatgagaatttaccgaaaaatatgagcaaaggaaaaaagaggtttttaggtggatgaaagtgcccaggtagatccttagacatatgaataggtatatgtgatgggagattaattgtttactttcattaatatttagtgggagcctatgcatattaggaactatatcaggaactgttttaggtaatgagaatcccaagctgagcttatattgtgtcaggaagggagaaaataaacctattaacaaataaaagtataattcctactctgccctcaaggaggtggagcttgtcttcctaccccataagtgtgggtagcatatagtgcctttctttcaaagaacacagcgtggaaaagagtaggaggagaaacaacttcccagtggagaaacctgacaaacttttcctccaccaggtcatgaaggtcaacatcaacagtcataaatcatgtgtataacatttacctttgatacactgcgatgaaaagggcacttcacctctgcagtctttctccccagaacacataaccctagtctaatcatgagaaaaaatcagacaaatttcaaaagggaaaaattttatagaatacatggccaatgctcctgaaaacattaaaagtcatcaaaaagcagtaacgtgtgaggaattatcccagcagagaggagaccaaggagacatgacagctgaatgtaatgtgttgtcctggatgggatcctggaagggaaaaaggacactaagtaaaaactaaggaaatatgaataaagtatggacgttagttaatcataatgcattgatattgttttattcactctgacatatgtacccctaatgtaagttgttaataacaggggaaactgagtgtatgcaatatggactctataacatcttcataatttttctgtgaatctaaaccattttttaaaaatatataataccaagtcggttgatgataagtgctatgaaacatagtaaggcaaggaatggggtcaggaaggggctggggagtgaggagtcttttggcaaaggtcctaggggaggcctccatgagcaggtgtatttgaaagagtcctgagtgaagagggagagatcatgccagcacatgggaatgcagatcctaaggccaaaaggctgagacaggcttgttgtgtttgaaggacagcacgcatgcaagcatgcatagagcacagtgagctagcgggagtacgatgaggttagagaggaagctgaggctagattatgtaaaactttgggggtcatagtaaaggatttgaattttacttggagtaagattgaacagtgttgcatgatttgccttgtatattcctgagatttacctggttgttgcctgaactatagatagtagagggcagagtggaaacatgtgaacacttagtaacctattgcagtggactagttaaatgtcgatggctacctgggccaggatggcagtggtggcattggtaagtagtagtcaggtcttggatgtgttttgaagaaacatggcatgctgatgcatgagaatcagggaaaaggaaaaaattaaggatgttttaaaattctttgggaaattgggtggatggtagataggtggtctgagtccataaactgaatgagaagaatggtggagtaaaagggtgcagatggggttaatagatttgatggtgtaaggctgaagaccttctctgattaaatctattttttttttttttggaaaatgagaagcaggtcagtaagctgggaggaacttagggagcaacagatttcagtgttaaaacaagaattcaaattgagagatgtgaagtttgagattcatgttaggcttccaattagagaatcagatggttagttatgtagatgactttggaaagcaaggtagtgataggagctgaagtatacacttagttaccagtttatatgagtgtttaatcaagcataaattgtgagtttacatagggaatgaccgtaagttagaggtgtctgaagactgaggcctctggaactgcaagagtgagtggtcagaaagaaaataatttaacaaatggacattccattgatgtggaagtaaaagcaaacagtgattgtattgcaggagccaaatgcaaaagttgttttaagatagaaatcagttggaaatgggttccaagatggccgaataggaacagctccagtctacagctctcagcacgagcgatgcagaagacaggtgatttctgcatttccaactgaggtaccgggttcatctcactggggctcatcggagagtgggggaaggacagtgggtgcagctcaccaagcgtgagctgaagcagggcgaggcatcgcctcacctgggaagtgcaaggggtcagggaattccctttcctagccaaggaaaggggtgacagatggcacctggaaaatcgggtcactcccaccctaatactgtgcttttctgatggtcttagcaaacggcacaccaggagattatatcctgcacttggcttggagggtcctacacccacggagcctcgctcattgctagcacagcagcctgggggaggggcacccgccattgctgaggcttgagtaggtaaacaaagcggctgggaagctagaactgggtggagcccaccgcagctcaaggaggcctgcctgcctctgtagactccacctctgggggcagggcatagccaaacaaaaggcagcagaaaccgctgcagacttaaatgaaccctacagcttggaagacagtagtggttctcccagcatggagcttgagatcagagaaaggacagactgcctcctcaagtgggtccctgacccacgagtagcctaactgggaggcacaccccaataggggcagactgacacccatacggctgggtacccctcttggacaaaacttccagaggaacgatcaggcagcaacatttgctgttcaccaatattcgctgttctttagcctccactgctgatacccaggcaaacaggttctggagtggacctccagcaaactccaacagacctgcagctgagggtcctgactgttagaaggaaaactaacaaacagaaaggacatccacaccaaaaccccatctgtacatcaccatcatcaaagaccaaaggtagataaaaccacaaagatggggagaaaaaagagcagaaaaactggaaactctaaaaatcagagcacctctcctcttccaaaggaatgcagctcctcaccagcaatggaacaaagctggatggagaatgactttgacgaattgagagaagaaggcttcagacgatcaaacttctcccagctaaaggaagaagttcgaacccatggcaaagaagctgaaaaccttgaaaaaacattagacgaatggctaactagaatagccaatgcagaggagtccttaaaggacctgatggagctgaactacgtgaccaatgcacaagcttcagtagccgattcgatcaactggaagaaagggtatcagtgatagaagatcaaatgaatgcaataaagtgagaaaagtttagagaaaaaagaataaaaagaaatgaacaaaccctccgagaaatatgggactatgtgaaaagaccaaatctacatctgattggtgtacctgaaggtgacagggagaatggaaccaagttggaaaacactctgcaggatattatccaggagaacttccccaatctagcaaggcaggccagcattcaaattcaggaaatacagagaacgccacaaagatactcctcgagaagagcaactccaagacacataattgtcagattcaccaaagttgaaatgaaggaaaaaatgttaagggcagccagaaataaaggtcaggttacccacaaagggaagctcatcagactaacagctcatttctcaaaagaaactctacaagccagaagagagtggtggccaatattcaacattcttaaagacaagaattttcaacccagagtcatatccagccaacctaagcttcataagtgaaggagaaatgaaatactttacagacaagcaaatgctgagagattttgtcaccaccaggcctgccctacaagaacccctgaaggaagcactaaacatggaaaggaacaaccagtaccagccactgcaaaaacatgccaaattgtgaagaccatcagtgctaggaagaaactgcatcaactaacgagcaaaataaccagctaacatcataatgacaggatcaaattcacacataacgatatttaccttaaatataaatgggctaaatgctccaattaaaagacacagactggcaaattggataaagagtcaagacccatcagtgtgctgtattcaggaaacccatctcacgtgcagagacacacataggctcaaaataaagggatggaggaatatccaccaagcaaatggaaaacagaaaaaggcaggggttgcaatcctagtctctggcaaaacagactttaaaccaacaaagatcaaaagagacaaagaggccattacataatggtaaagggatcaattcaacaagaagagataactatcctaaatatatatgcacccaatacaggagcacccaggttcataaagcaagtccttagaaacctacaaagagagttagagtcccaaacaataataatgggagactttaacaccccactgtcaacattagacagatcaacgagacagaaagctaacaaggatatccaggaattgaactcggctctgcaccaagcagacctaatagacatctacagaactctccaccccaaatcaaaagaatatacattcttctcagcaccacactgcacctactgcaaaattgaccacatagttggaagtaaagcactcctcagcaaatataaaagaacagaaattttaacaaactttctctcagaccacagtgcaatcaaactagaactcaggattaagaaactcactcaaaaccactcaactacatggaaactgaacaacctgctcctgaatgactactggggacataacgaaatgaacgcagaaataaagatgttctttgaaaccaacgagaacaaagacacaacataccagaatctctggaacacatttaaagcagtgtgtagagggaaatttatagcactaaatgcccacaagagaaagcaggaaatatctaaaattgacaccctaacatcacaattaaaagaactagagaagcaagagcaaacacattcaaaagctagcagaaggcaagaaataactaagatcagagcagaactgaaggaaatagagacataaaaaacccttcaaaaaatcaatgaatccaggagctggttttttgaaaagatcaacaaaattgataaaccgctatcaagactaataaagaagaaaagagagaagaatcaaatagatgcaagaaaaaatgataaaggggatatcaccactgatcccacagaaatacaaaataccatcagagaatactataaacacctctatgcaaataaactagaaaatctagaagaaatggataaattccttgacacatataacctcccaagactaaatcaggaagaagttgaatctctgaatagaccaatagcaggctctgaaattgaggcaataattaatagcttaccaaccaaaaaaagtctagaaccagacagattcacagccgaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaattttagaccaatatccctgatgaacattgctgaaaaagtcctcaataaaatactggcaaaccgaatccagcagcacattaaaaagcttatccaccatgatcaagtgggcttcatccctgggatgcaaggctggttcaacatacgtgaatcaataaacgtaatccagcatataaacagaaccaaagacaaaaaccacatgattatctccatagatgcagaaaaggcctttgacacaattcaacaacccttcatgctaaaaactctcaataaattaggtattgatgggacgtatcttaaaataataagagctatttatgacaaacccacagccaatatcataatgaatgggcaaaaactggaagcattccctttgaaaactggcacaagacagggatgccctctctcaccactcctattcaacatagtgttggaagttctggccagggcaatcaggcaggagaaagaaataaacggttttcaattaggaaaagaggaaatcaaattgtccctgtttgcagataacatgattgtatatctagaaaaccccattgtctcagcccaaaatctccttaagctgataagcaacttcagcaaactctcaggataccaaatcaatgtgcaaatatcacaagcattcttatacaccaataacagacaaacagccaaatcatgagtgaactcccattcacaattgcttcaaagagaataaaatacctaggaatccaacttacaagggatgtgaaggacctcttcaaggagaactactttcactgctcgatgaaataaaagaggatacaaacaaatggaagaacattccatgctcatggataggaagaatcaatatcatgaaaatggccatactgcccaaggtaatttgtagattcattgccatcccatcaagcaaccaatgactttcttcacagaattggaaaaaaactactttaaagttcatatggaaccaaaaaagagcccacattgccaagtcaatcctaagccaaaagaacaaagctggaggcatcatgctacctgatttcaaactatactacaatgctacagtaacccaaacagcatggtagtggtatcaaaacagagatatagacaaatggaacagaacagagccctcagaaataatgccacacatctacaactatctgatctttgacaaacctgacaaaaacaagcaatggggaaatgattccctatttaacaaatggtgctgggaaaactggctagccgtatgtagaaagctgaaactggatcccttccttacaccttatacaaaaattaattcaagatggattaaagacttaaacgttatacctaaaaccataaaaaccctagaagaaaacctaggcaatacccttcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaccccctcaacaagtgggcgaaggatatgaatagacacttcttaaaagaagacatctatgcagccaacagacacgtgaaaaaatgcttatcatcactggccatcagagaaatgcaaatgaaaaccacaatgagatgccatctcacaccagttagaatggcgattattaaaaagtcaggaacaacaggtgctagagaggatgtgacgaaataggaacacttttacactgttggtgggactgtaagctagttcaaccattgtggaagtcggtgtggtgattcctcagggatctagaactagaaataccatttgacccagccattccattactgggtatatacccaaaggattataaatcatgctgctataaagacacatgcacacgtgtgtttattgtggcactattcacaatagcaaagacttggaaccaacccaaatgtccatcaatgatagactggaataagaaaatgtggtacatatacagcatggaatcctctgcagccataaaaaaggatgagttcatgtcctttgtagggacatggctgaagctggaaaccatcattctcagcaaactatcataaggacaaaaaaacaaacaccgcatgttctcactcacagttgggaattgaacaatgagtacacttggacacaggaaggggaacatcacacaccggggcctgttgtggggtgggggcagggggagggatagcattaggagatatacttaatactaaatgacgagtcaatgggtgcagcacaccaacatggcacatgtatacatatgtaacaaacctgcacattgtgcacatgtaccctagaacttaaagtatatttaaaaaaatgctgggtgcggtggctcgcgcctgtaatcccagcactttgggaggccaaggggggcggatcacgaggtcaagagatgagaccatcctggctaacatggtgaaacaccgtctctactaaaaatacaaaaaattagctgggcaaggtggcaggggcctgtagtcccagctactcctgaggctgaggcaggagaatggcatgaaccccggtgggggagcctgcagtgagctgtgatcctgccactgcactccagcctgggcgagagtctgactccatctcaaaaaaacaaacaaacaaacaaaaaacaagaacaaaacaaaacaaaacaaaagagcacctacctcgtagactgctgtgaatcttaaaggtgccaatgcacactaaaactttgcatatttccaggcacatagcaaacccttagcattacctatctcaatatttttcttggttttgttttgaataaaagcatttggacctaattttaattgttaattataataaataatttatttgtgaaaaaaagatagaaatctattgtgtcaaatgctacaaagagtcaattaagtaagttcaggtgtgggaactgaccagtgaattaactcccttgacaaatgcgtgttagggtaatgatgaggataaaggcatgactcgatggaattcaagagagattaaagggtgagagagtgaaaacagtgtaagcaacacttgctgtaacttttgtcaaaacgaggaaggaaatgttaatggtatctgttgaaggaaataaaaaaaattttcctattgggtatttattgagcacaatttttatttggtgaaaatgatccaatagggaaagaatagttgatggcatgcaaagagatgggaaaaattgtaggagcaaagcactttagggacaagaataaataggacccaggtcacaaataaagggatttgcttagatagggggtctgagtccattcactgaatgagaagaatggtagagtaaaagggtgcagatggggttaatagatttggtgtatggctgaagaccttctctgattaaatctatttttttcagaaaatgagaagcaggtcaccagctgaaaatgaggggggtggagtgatgatttagtattttaaaagcgaagaaaaagtgagaaatagttgttttggtgagtaagagagtgaattggatgagcaaatataatagatttcctggacagagtttggatcatacatttgaagttaagcacagttagcatgtactgtgatttctccagcttgaatcatcttgcaaggatgatagagacaaaagcaaaagtcgaatttaagccaaaattcggatttcgtagatgattatgatgaaggaaacaggcaagaaaaagaatgacatagacaagtaatgagatgataacaatagatgaatcatacagactttcgactgaatacaaaggtagtgacaaactgatggaaggtggagaagaaaaggggaaaatgttaatggaatcacagacctatctgatgagttgttggagtgttggagtgagagatctagagaaagtagaaatggaaaaatgagtgttgctacacagaagactagatgctgaggtgaaatatttaattatgtttgagttattggtaaggacagtctaagaaatggcctgggaagtggggacagttagacaaaggaaggtggaaatgtaagatggggtgtttggaagataagaagacaagctattgagaagcttgagtagtagatggttttgagtgatcaaggatgatgctaagagtagtaagcagtggagaaaccgagctaaattaggtgctaaaaatcttgcaaaaattaggaggattgctcagaaggatagcaatgtgacaaaggaaaatagtggctggtataactttgcagtgtatttgtcaaagaagctggaaggtttagggaggatgaaggagcaatattctggaactgacaatggagatcaaagaggatacttatcctaagcccagtgaaataagaaagatatcacgccatgggagggctgtagggaaggataacctctggggagagccaggtttgtagaatggaaggtaaaatatttagagaagtggttgaatatataatatggagattttacttttcctagagtttaaattctggagaaagtattttgaggagtctggaaaggattacagcttgagtcccatgagggaacttacagaacagtggatggaagaacaaattttgacttattgtagtaatagagacaaaaagggcatcatgctagtgttctcttatggagagggggaaactaccagagtatacacaaagactaaagaacagagtatgaatatcttgattaagaaaggtcacttgagcaattcctagtgatgtagcagacagtgttggatggagagaaagtggagttctataagcctccaggaaatccaactgtgggtattgttgataccaaaactgaagctaagacagcaagctaaagtcatgggaagaagattggacttagtctttaggcattaggatgctgtattaggttgaataatgacactctctgatatggttaggcttggtgtccccacccaaatcttgaattgtaatctccataatccccatagtcccttcatatcaagggagagaccaggtggaagtaatggaatcatgggtgcagtttcccccatgctgttctggtgatagcgagtgaatctcacaagatctgatggtattataagtgtctggcatttccccttctggcacttctccttcctgatgccttatgaagaaggtgccttgcttcgtcttcaccttccaccttacaccatgattgtaagttttctgaggccttcccagtcatgcagactgtgagtcaatcaaacctctttcctttataaattgccccatctcaggcagttctttatagcagtatgaaaacagactaacacactccctccccaataatatgttcataaccaccaaacctgtaaatctaaccttatttggaataagtgactttgcttttgtaatgaagttaaggatcttgagatataatcatcatggatgagtataagccttaaatctaatgacatctttataagagaagagaagataaaagaagataaaagaagagaagagaagagaacaaagacacagacacagagaagaatgcgacatgaagacagaggcagagattggagtgaggcaacaagccaaagggcaccaaggattgccagcagccatcaggagccaggatagaggcatagaacagagtctacctcagcgtccagaaggaaccaaccaaataccttggcttcatactctagcgtctagatctgtgagtaaatgggcttctgtggttttaagccattaaatttgtggtaatttgttatgacagtcctagaacactaatccatatgcctaagtaagaataacttagtcacatatatgaacacatatgcatgacttctcgcacttttgaagcagctaattttcagagacctgtggccagcatggtctgagatgtcctcagcccagagtgcttattgaattgatagaaacacatagtaattgcattactgaatgctattctaatattgtgttagaaataactttatgttaacagaatgtgcaaagagattggaataaattaggtgcatgagaaaaaaatattgtgtgtaaatgaaagcaggtcaaatatttcagtagatgagttaacccaaagacagttttctgaagctggcaggactccttcttcataagatcagcaagaactgattgaccaacatgccttggggtatgaagggacaagaagtgtcatctgacctgactttgtgccttgacttaggactggcccccaaaatacaccacagaaaacaaaataacacatctctgcagaaattctcttggactctttctgtttgttctttagtcttcatggattctctggtagtttctactgtcttcccccatgatgtggagaagtttcctccagtctgcttcaccctgtaaagtagattgtccgtgatcatggctatgccatgaggaatcgctgtagtttcccaatgacatcctggtattggctcacctggtagatgcttcctctggcttctctgtgataggtgatagacttttgtgttattcatttgtacatcaatttgaccaatattttacctcttactctttgccaagcattgttttagatataggagataaaaacatctcataaggcatatattttagtgaatgagcaagaaaattaccatgtgaaaacataaatgccacttcagaaaagaaacaaaataaggaaatatacaaagaggaatgttattttggaaagagtaatgaagacaaactctaaggggtgacagtagagcacagatatacattatcatgcatgtggggaagaatattttaggtagagagaagagcaagtgaaaagcccttagaacttgctatatgtgagtaacagcaggatgctgtggactgagttgggggaagagatgaggctagagagactggattttaagtgtcattgttttaaatgatggtggaggagtaaagggagccacataaactgatttatatttccaaaatatcacaatggcttcagggtgaaggagatagtgtagaagccaagagtggacttggagaaccatttgagagatgtccccagtagttgagatgagagatgatagtgactgggatgatggtgacaatggagaaagtgccaaaaagcaaactgattccaggaatatttaagggtagagtcaacagaatgtgccggtggacttaaaaatggatgtgaaagaaagggagaaatcaagactcctgggctttggactaacaattggatgaatattgattatatttattgagatgaggaaggctagtgaagtgtcatgttgagataggagatgggaaacaaaagaggtctgtttttagatatgtaagtctgcaatgtatttctgatgtttagatgagacattgtataggcagatagaaatatgagttgatgctcaggacagaaattgaagctagagttacaattatggtgtgcaaagccatgaataaggatgagctcatccagggagtgagcggaggacgaaatttccatgctggcatggagagataacaaagaggcctggaaagtcttcaaatctgcaaaacagtattgctgccacccaaactatcctcttgtgtaagagagatggacacagcactgatggaatggtgtcaaaggcatcatcacagacttcagtattaaattgaagttgtcatttgcttgtcttccaattatatcgggacactgggtaaatgtactaatctttggtgatttggtgtgtgtgtgtgtgtgtggctgggtgtgctctgtgtgtatttatgtgaatacatggacttttaaaatatggatgattatgaaatatattaaaaatgggtaacccatatccacttgctttgcattataaagctttcttcctgagaagctatgctacgaaacattggggacaacttttttttttttaaagagaaattgagactattgtgtcctggcatcaggccaccatcaaaatgagtttgagtttggtattacagaggatgagaaatttaatggaaaaatttaagaggaactttgagatgtggaattaaatcttaataatgtgatcaaggctggagatatgaatttaggtgtcttccatttataagtgagttttgaaaccatagaaatggacatgttttccaagagaaaagcatgcccagagacgagagggcagggagtaaagctgtgtccttgtgtaagggcatggattcttatttgacagctaaacttatacaacacagagaaatgtcattccaagaagcttaaagcttagcatgtggaagcgtcacattaaatatttttccagttcatgaaaaaagggagtaaatgaagacgtagttgaaaggaaaagaactttgcacagaaatctgagaagaaatagttggagatatagcagcagaaccaagttagaatgttgtcaaaaaaggcaacatggtagaaaactaagaattctgaagttgtttaaaatattaaaagagaggaattcagttagcaatgagtcaatactcatagtttattgttgaccttgatgacagcagttttaacatgatgcagtagaatgctaggaaatgcagaagagtcataaatccaaggaacaaagtgagggtgagtctctgaaggctttctggaagaagtgttactaggctagagtcttaaatggctaggaggagtttcccagaaaaagtcggaaggatgaaaaatattaattaatattttccaatcactgtgtgtcctgttccttttgaattaacccctgacagctctatggaatgtgattcttattcacaaatcctattttatactaactgaaaagaatctcacatcaatcaagttctaataatgactatataattttttgagtaccttctatgtacctgaatctgtgcaaagtactatggtagatccaaaggtgccagagcactgttctgttctcaaagtgcaaatgctacatttgcagatcaaaaaaaattaaggtccatttataaagcacaggttacatgtctggtcctatgctctggattgcgggcattaagataaaaacataaggcatgtttttggagaattcacagtctagtaatatttgatatacatgcaaacagacacagtttctcatgatctatgatatgacagggtactgtgagaacaaagaggagggatgcctaacctaggtcacatgaggggtcatggaaagtatagaatgggtaaaccttgagtgcagtcttgcaggggactctatctaggaagttatctaggtgaagttatctaggagaagcagaatatcctgcaagggttaatgcagagatctgagagagtaagttgcatttgagcattcagaataaacacctgaaaagtaaaatatgaaggtgagggtgatagagaaaagacttgaaagcatgaattttggctacaaaatgataacctcagattatccagaaaagtgtgactttctaaccttttaacaattccatacttcttagtaaaccttccaataacatcatctttattaacagcttctacaaacccactagcatgatggagttctgcttcagcacatctggatcccaaatggttgtcattagtcatttcaaaggcttagcttattttatttatgacttgcttcaataaacacactattcctacatggaatttaatgtgaacttttgacagtgattactattcaacatttggcctctaatctcttctgtgcctcgaagtagttaacgagcactcattcaaccagaatttattgagcacttgctacatgtctggaaccaggacaggtgccttacagtggtgcttctcaactttactcttactaaacattaaatatcactctttaaaaaatatcaattgcaatttcaaaattagcttcaatttagaacaacagatatttacagaagacaatttcgatatggagatgcttaaaggcttttcttggctcatacgacgacaatagaaagacaaaggtgcacttgattgcttgttaaaaacttctctatcctaaatttataatgttcatttaaccaatatttattgaaaatcagctctgcactgagcactgatcatttttgggatacttcaatgaatacaacaaattaaaaaaaaacaaaacctgaaatggagcttatgttctaggaagtccagacagtaatatacacaaacaaaatgaataagctaaacaaagtttacctttccgttcaagtctaaggtgctgctgctgctgctgctgaaattcatcatcagtgcaaataatggtctcaaaacccacgtgaaagattgcaggacaagggaataaaaaaacttcccttggaatctttcagtcaaagactaagcattggttacttaagctcacaggcagatatagaggtggccgtagaggtccctggaatcagactagcttggttcaagtcttggtccccccacttccaggccaggtgacttcagcaagttacctggcctgtctttgtctcatctcctcacatgaaaaaagtggcattaatcttcccatcatagcattctgtgagaattaagtgagataatacacataagatactcagaggtgttgaggatcaagaccgctgatggcaggtacccgtgtctgacatagactaaattctcagtagatatcacttattattattgctgagaagacagtttcattcatgtgtttaacagaaactttcagctccaatgtgaagaaaatatcttctgcacacagagtagatgagatttgatactttccctcaaatcgctttcaagatctttgtccttgagagtctcatcaatctgagaacacgaagagatgttttagtaccaattcacagtgttcatagatatattttggctataaatggtgaagtatgtcataataagtaaagctattggtatttgtccctaagctttttgtgtcatgtattcaaagcttcaaaatgtatgtttttatatgctgaacagaactgtaaagcataattgtgggaagtttggagcaaatgattgttttaatggctttcccaaagcagcttatttccccttgaccactaacaaccatacaattgaagaactttgtgattggtcttcagatttgcacagagacaggcagtggccatgtttttatctttactgtgcttgtcttgaatgtcatcagctgacaggaagcatagcaagactgaaggcctcttgtgagttaatgggcaattttagttgtcaaagccaggtagagaataatggaaggagttcttaaaattaaagtgcgtctgtgagtgtgtgtttaaatgaattgtatttgttttgtttttcttgtctttatttcttttttctttttttctaacagaagaaatcctgacactcctgcagaaagcttggctgactcacagtcagaacaggccctctttattaatttcaaattcacctcattcactccaggacatagctttaaagaaaaaaaaaattagcatttttttttggtaatatcctaggttacagaaagcatcaattcttctgcacatagttaaacacaattcctcttatcactgaaggctttaaaactaaaagctaaagagagtgacaaccatatatttgaaaaatgttgttgatctcctttgttacattaccaatttggcacttaactgaaatttcttttaaaatgtataatccaagcaatgttttccaaagtagctattctatacatttttataagtttttctatgttttttaaaattttctatttcataaaatgttttcttaagctgtgaattcctggtactctttagtccaatattgcctagcttcatgagtaggaagagccaaattaatcaaccaatcacagaaacaaacaagcaaacaaataataaaaaacatttgtttaaatcatgtacaatataaatattttttacttaactaatttttaagtcaagagagctctgctcaggtttaaaacataaaactcacagacaaatttctacactcttctttacaatgtatacaaaaaacaccgactaggaatgcactggaggttggcattggccttgatatttgaccaaaatctgatatttggcttctatattagtattcaaagggctgagtgtctacttcagtataattttaattttgtgatcagatagattaccatcgatctagtcacaataaaggcatgagtaccaggagcacagacaattttgattctttaatgcctaaatattatttttcagatataaaaatatttacctgtaacttgaagtgaacatttctcgccctacttttatacatgaaaaaattgtctacttggttgaagagtaaatctatatttactattacaagtagaaaatgctgcaaaaataaataatgttgattatgaaaaatgttaattttattttaaaaaccaataaagaattcaccagtaaagccatctggtcctgagtttttctttctgagaagtttttggttgttgattcaatctccttattctctattggtctgttcaaacattctatttattcataatacaggtatggtaggttgtaagtttctaaaaaatgtatttatttcttctagattatgcaatatgttggcaaataattgatcagaataatcacatgatttttttatttctgtggaatcagttgtaatatgttcttttacagttttgtttttatttccatcttctggtttttttttgtttgttttctgaaagctaaaagtttaacagttttgtttatctttgcaaaaagccaacttttagttctgttgatttttttctattgttttcctattctatatttagcttatttctgctttaatatttattatttcctacatcctactaactttaggcttgctttgtcctcctttttccagctcattgatttgtaaagttaagttgtttatttgaaatttttcttctttaatatagatttttatcactataagcttttctcttagaactgcttttgctgcacctcataagttttggtatgttttctaaatttttatatattatctaaatccccttacaatatattccttggcccattggttgtccaaattccacatatttgtgattttttccttctttttgtcatttttagtttggtatttttagttcttagtattttttagtaatttttttagtatttttagttttttttctgttattcatttttagtttcattcatctctgttggaaaagatacttggtataatttcgatcttcttaaatttattaagacttctgttgtgaccttatttgtgatctgccttggagaatgtttcatgtacatttgaaaagaatgtattctgctcttgtaggcagaatgttctgtttatgtatgttgatccatatggtgtatagtgttgttctagggagaattaacaataatccttcaaaaactcttccaaaaaaattaagaagtataatttccaaactaattttatgaggtcagcattatcctgataccaaagcaagacaaagacactataagaaaagagaactataggccaatatccttgataaacatagatgcagaaatctttaaaatattagcaaactggggaaaactggctaactatatgcagaagaatgaagctggactcctacctctcaatatatccaaaaattaactcaagatggattaaagattttagtgttaagaccttgaactataaacctcctagaagaaaacctaggaaatattcttctgtacattggcctaagcagggaatttatgaccaagtccttaaaagcaaatgcaataaaaacaaaaattgacaagtgggacatagttaaattaaaaatcttcttcataacaaaagaaagtatcaacagacaacctacagaatcagagaaaatatttgccatctgtgtatctgagaagggactaatatccagaatctataaggactttaaatcaagacaaaacaaattacttcactaaaaagtggtcagagaacatgaatacacactttctaaagaagatatacaagcaaccaatgaacatatgaaaaattccctgcatcactattggagacatgcaaatcgaaaccacaatgagataccatctcacaccagtcagaatggctaatacaataaagtaaaaaataacgtgttggtgaggttgtggcaaaaagagaacacttatacactgttggtgggaatgtaaactgattcagcccttaggaaagcagtttgaagatttatcaaagaactaaaaatacaactgccattcaacccagcagtcccattactgggtatatacccaaaagaaaatgaattgctctaccaaaaagacacatgcacttatatgttcattgcagcactatttacaacagcaaagacataaaatcaaactaagtacccatcaatggtggatgggataaaagaaatgtagtacagacaccatggaatattatgcaggcataaaaaagaatgaaattatttgctttgcagtaacatggatgcatctggtggccattatcctaagtgaattaatgcagaaactgaatacaaaatactgcatattctcacttataagtgagggctaaacattaggcacacatacacataaaaatgggaaaaatagacactagagaccccaaaaagtaagagaaagagggacaaggggcaagggttgaaaaactacctattagtactatgttctctatatgggtgacggaatcaatataaacccaaacctcagcatcatgcaatatacctatgtaatgaacctgcacgtataccctgaatctaaaataaaaaatatatattttaaaaactggcaagataaatttgataacacattttttagttcttcttcaaatatttgtgagaattcaccagtgaagccatctagtccagggcttttctttgttgggaagtttttgatttctgattaaatcctgcttgttataggtatatttagattttctcattttcttgcattagttttggtagtttgtgtctttctaggaatttgttaatttgatctgcagagtattctttcataatcctttcaatttctgtaaagtttgtagtgatgtttctactttcacatctgactaagtatttttgcttcgtgattaattttttgttagtcaatttacttaatgattgactaattttattgatcttatcaaagatccaacttttggttgtactgattctctctattgtttttctatgaactattttgaatgtggctttctaagattaactgtattcagtgcttttggatgttgtaatttcctacagaaactctttcccagctttgcttcccaggctttagggagtcttttgtacatcacaactacaatcttttgccccagataactgggcttttgattcatcatcaaatgtttttgagcaatgccttctcctttttctccttgagttctgagttaggtgaaagagagataagcatcttccgcagtccttcatgtagcctctagactagttagaacagacaaacacacgaattttcaaataaagtctgctcagctccattaagaaccagggacaaggactgcactggaaatgcagggtgtcactttcaagtctgcagcagaactaggaagggtagccaagggcaactgaaaatgccacaaactttttctactatttttatgttgcttttttcttgattcaacattcacttacttcctgtatgcttttgaccattttctggggctgtgacaaagcggtttcttataattctgcttgctttttgatgtttttgtggaggaacaggtgtttcgagccacttgctccatcagtttgcttacctcacctatccaaatttatttttgatcccagaatttaattctatgatagtgattatcagttttggcctcaactttcagccactttataaaattgggccttttgacatttggccaaaatgtgtattcatttcaccttattattgaaatgggaggaattttcccttatccccctagcatggccagcgacagggacgggggtgtggctgagttcttcagtgccccacagctcgaaaccctagggggaccaggcagacgggcaggccatggggagcatttttgggcttcgactctatggcgatgtctagggttgagagtttacagctcccaaagccccagtgggtgtgtattacagtgtgctctttcagttttgccgtccacaggtggcttgtgttaaacagctcagttagaccctcgctttatcgcaaggacagagggatttctgtatcttgggtgcttgccttagtgtaccgaaaaaatcagatcacgcttgggcttggaggatgggtgcaaggttttattgagtgctggaagtagctctcagcagatggatggggagccagaagggggatggcgtgggaagatggtccttccgtggagtctggcctctcagcagccaggctcttctccaaccgcctgcccttggccgaattcccctctgcattcgcgtcgttctgccctccatggcctgcgagcgtctgttggtgggtgtgtttctctggaaatccagccacttgtacgtgcccgctagggcctcggggtttttataggcacaggatgagggggtgtggcaggccaaagtggtcttggcaaatgcaacatttgggaacgaaaacaggagtgcctgtcctcacttaggtctgtgggcacaggcccaaggatggatcccgtggcagggaccccattcttgtctccccagcactttcctgcagccctcccatatctttaggaactttggaaaatgttcagtcttgtcacaatcttgatttattccttcttcttccaaaacataaatatgaggagtattaatgaggttgtctaatttacgttttggagaaattaatggattcttggcttggctatctgcagtatttactcatgtctgaaccttaagcaaacctgctttcacatttatgtcttgatctgtagtctaacacttgactcaatttaataatgcccaaaagaagattaaaatgctctttatttgataaaatagtaatttctagcataatgatttcaagacaaaatttttaaaaatggaagtggtaacaaaaataaccttgttgagttcaaacccgatatagtttctaagaccaacaaacaaaaaatagtttttaaacttcttcatttttaaaaatagaaagcttatttacatttataatataagaaacattcttgaactgaagtgtaatgcaaataggaacagtggttatgttttagaggatgctgtcacttgagtagtttcacccatcagacaaagaaacaaggatggcagaaaacacagcacccttttcatgtgtaaaatgtgacttgtcacctgtcaaactctgaatgataatctggaactcaactagttggcaatttgaaaagtacacacaaatatttatccaatatggcacacaaaacaactaccattttggagagccttgaggcagtatctcattaattttaagatgtgcatacattactatctagaaatgcccacagttaggtagctaccttagaaaaattttcaaatacttgtcacaaggacacatgtaacacaatgttcttttcagaattctataacacaaaataatcatagaaaatcaaaattattacaattagagaaaaaaaattaaatggttgctcttctttccatccatgagtttaaaataatatatcaaattaataagcatagataaatgaatgagatctacatgtattaacattgatataaacattacactgagtgaaaagttgtagaaagatacatttcatcagttacatatatttgagaaacacaggaaatactatatattccctcaaatgtttttgagcaatgccttctcctttttctccttgattgagttctgagttaggtgaaacagagataagccatcacttcttttttcatcctagggtgaaatttgatatcaccctatgatatttgttatttgaacaataagaatattttttcataagtattttctttagttgtccccaaataagttaatattacaaatatagaataggcttgtttacattaaaaacacccttctccatcaaagaaattgtgatggttgtactgccctttcaccccttaggtggttgcactgccctttcacccctccttcctactcccaccctggataagccacagctccggggcacgtgagagtaatttcttataagatttctctgtgatagacttcagaagacaagttatatactcatgagattctgaaattgtaaaatattagtgccaaaaatccctcaagaactgaattatcttttacaacacctcaatgaaaagactaagaactgaaggttagtggggtgtattcacctttctagggtcacataatgaagcagggcatgtaatacacagcaataaaggagaagaaagggattaaatgctgaagtaagtggtgaggttaacaattctaaaaaaggcagaaacaaaattgatttgagttgtttaaaggttacttaacatttcatgtaaactttcatagtacagaaaactataggaaagcattccaaatttgcggaccacagtctgataaaagaaatgaatagcttattcttaaacaagatctgtttggcccatctaggaagttatgctgggaaagacatgaaattaacacgcattaagagatagaccctctatctgtgcaatgtttcttctctcataattaagaaaaatccactgaattcatgccaggaagtctgtctgaccctgatgcctaccttactgtcaccataaaacactgtcttccaggatgttggggaatggagagattgaatgggtgtacattttgggaaaaaaaacttcaaaggcaaatattttgtgtgcggctttaatgctaagaccagcaattagctattgaggataattataccatggggctaacttctatgacatttaaattcgttttcattgtgaatcatttcagccatataaaaaagaatagcaatataaaaaataatccatgtgtttactaatatgatttatgaaatgttgacattttgctgtatttgtttcatgttgtttttgtttatcttagaagttttagataagataaaagctcctcctctttttgttccccatctttcagtcccagaagtaaccatttcctgaagcaactattttggtgtgtggcctcctgaagctacttcattctttacaacatgtctaccctatatattcttatgtgtataaagcctatataatatttcctgtgtttctcaaatatatgtaactgataaaatatatccttttgcaacttttcaatgtaatggttatatcaatgttggtacatgtagctctcattcatttatctatgcttattaatttgatgtattattttaaactagttgattgaaggaatagcaagcatttaatttttttctctaattgtaataattttgtttttctatgatttttttattatagaattctgaaaagaacattgtgttacatgtgtccttgtgacaaatttttctaaggtagctacctaattgtggacatttctagatagtaatgtatgaacatcttaaaattaatgagatactgcctcaaggctctccaaaatggtagttgttttgtgtgccatattggataaatatttgtgtgtacttttcaaattgccaactagttgagttccagattatcattcagagtctgacaggtaacaagtcacattttacacatgaaaagggtgctgtgttctctgccatatttgttttttttctttgtctgatgggtgaaactactcaagtcacagcatcttctaaagtatacccactgttcctatttgctattttttgctttttgtgatacaaaaagaaggggtaggaatttgctacatgaccttgttccatgcatatttgctacatgagtcacatgtacacctgtgacctcctgcaagaatgcaatcagtaccagagaaagaatttgccctcaaacctcctccatgagctgataaagattcctgagtcctactgactgcttgaattgtctaatggataagatgtagagtctttttagtggactaattggtatcctgtcacatgttaaagatacccaaaaatatgaattgtccaaatatactagaagtcatttagtcattgaaggtttaccacccagaggccaaaatccattcaagcgtcaaacaactgtgtctcactccttcaattttaccctgatggaaaatggatcctgctgatggttatctgaggcaaactctatcatgactggttaataataatcatatttcttcttggtatacctttaccaaccaattaagcccttttctgtcagcgaagaaagctgaactgtgtctttcatttgaaccacatagcccaggaggtgcaaatcttctcctctgtcactagactctgagatctctaagtgatatggacaatgaagacctatgcatgtgatctttccagtcaatctcaagagctagaatcaagttctgccatacctagccactttgtgtcagtatgaaaaaggtgtttcttccatgtgaaaggagcgctgttcagggtgtattagttagagggaagagcccaggctgggattgggcccactaagccccttatcagggcagcccattgcagtcaacacccgatatggccataagctgcagctgtctgctaacagttggctccctttgttattgtgctgttccagagagggatttgggaaagggcagtaagagacacaaactcagattttcatcttctcacaatcctctccaacatgtttacattgtttatagataattttaattaaaggggattacaatgcagataaagtaattttatatcctattttgtagggttgtattgtattggttccattttctgatgtcattaaatttcaataaatgcaaatcttgcatattttattgtatgaatagatattgatcataagacttatgtgactagagctctgttttaaagacttttatttccagtaatttttagcttagtacataatgctctgataaacttttttatgcatacattttggtctgcttttcagactactctctcattctttcattttgcacatatatattttgtgtgttttatgggacagaaactgtttctagcacttttgatacaccaataatgaagaattaaaaggaaatatgggactctagaaatctaaataatttaatgttctttacaaatattggcagatttgcacctatgattttaaagttagagatggtcttcaagcactacacattttgaagccttgagattaatcactgattgttggaggtgggatcccaagacctgtctcttctttgctctacaatacaaaatattagaagttactttcaaaaaactattcgtcaaaggaaggtagcaatatcagctttattgagatcaaatgactgcagagcacgatttccacctgagatccacactgctggttctagtttctccccactgacaagaaagacctttgaagaagcagctgaagaagctaccagaaggcacagatcctggtaatattcctgtgctagccagaagctcagaaggcccaagcttcactcatccataaaacaggcaacataacagaagacgcagcttgttccttacacagaaatcctatgcaccctcaccaggttccaggatttatctcgctctttccagtcaaattatctatagctccttccagcttcctccattcagagaaagaataggcggcctatcttcagaaggaatgtgaggaggagtatttaagaaaagttagtcctttggagaatattgaatgaaagttatagggagcaatatggcttcccagaaggggtaaggcaatagggctctgattcctggacacttactatctatctaaccttgaaaaaattactcaaattatcagaacttagagagtgagaaataagacactcatttcatagtgttgcatgaattaaaagagataatattgttgagtaattttacctccctacgaagttgccaattcattgacagagagaaaactaaacacacacacacacaaaacaacaacaaaaatagttgtttgatacgttacctcattgaatgttatagccatataggtcaatggttaaattagagatgctttgtatatattctcattactaagacagtttactagatcttatggctcccatagtcccaatatacataaatcagtcacacataattgtccacatatgctccacattattacactaacatgagcttgcttattttatttgtatgtgatattaacagatttgtttcttacttgataggccttgaagatgacttagttgttgagttcagtacctgtgtctgttctaccgtgcactgaatgttactgacttgtacagaaatcatgctcaaggtttggtgtccacactgattgtctctagaagattaaaatatatataaatgacttatctatatttactacttttatttatggaaaaattaaattctttatagagtcttatggaagcttgctctgataaaatttttccataactgtcaaagtggaaagtatgacgagttcaggattagattagaatcctaatggtattatggccaggaacccaaatatttctgaatccttcctgggatatcaccttttttaaccataggataccagagagagttgcaaaacagaaaaaaaataataatggcataagtaggaatttggaatgtagtttatgtgcagatttctgtcaaaaggctaagtggacgctcatgtcttagcctagaagcttcattgatgcctccaaatctcctatcccaggatcctaaaatctggcatgctgcaagaaacaagacactgaaaaaggcttggagtctacagaaaaaccttatgaatccacacaactacttctgatggaaaataagacaagacagagattcactaagcccacctgagttgtcaagcatcacataccaaagaaaggcagaaactggaaggcaccaaaaagactgtaaaaagcatttggtttctgactgtaagacattgagacactcatttgttaggagcaactcctcagctcttggcgagcagtggggatgaaagcccagaaaggtagaagctcgctggtttgtggatagggttagaagtgttaacctttccctatatttccctctccttaggcaccttttaagcgattagacttaaaaaaaaaaagttcagtgaaagggcaagcagagaggtgggacccaccttaggataggaaagaaatagtcaaagctgctctctccctcctgctgtaagctactttctggggccctctttggcatcttggaagactaagatgggtaagttgtttctctaagaatccacgaaatagatcagaacttgaagttaattccaaagaggcaatgcacattaggatgaacaactattcctcttgaatttctcaactcatgttataccttgttatgtcctttaccctagtttaccagaagggcacattaggagtacatatattataaaaccatgatacaattaaaatgacatggagtcaaacaaggaaactgtctttcttccagagaaattacatttcaaattgaaatttcagaggtgacatgaatggaaatattgtaaaagtgatattgctatcgtcttttggccatcagttttctgaatatgccttctaatatttagatccctggagtgaaagaggggaagtcttgggaactcaaactccaataaattagaggtcaattataaggccatataaatgtttggtgcttaaagagcacctcactaaaaaatgataggagcaggccagatgtagtgctcacgcctgtaatcccagcactttgggagaccaaggcaggcggatcacttgaggtcaggagttcgagaccatcctggccaatatggtgaaactctgtctttactaaaaatacaaaaattagctgagcctgttgatgggtacctgtaatcccagctacttggggggctgaggcaggagaactgcttgaatctaggaggcagaggttacagtgagccgagatcgcatcactacactcctgcccaacaacgaagcaagactccatctcaaaaacaaaacaaaacaaaacaaaacaaaacaaaacaaaaaatctggtgtaaaatacctccaaaaagctgctcctttataaaggcaatgagtacactggaaaagtagtaaataaactttttcagaactcaaactaagcaaaagcttgcaaacaaaaaaatgaagttcttatttaaaaaaatagactgaatctcagtaaaagggaactttgtgatgttttaccttatactattctcagttccctccctttcagacccagaatagctgttacagattgaattaagtggttttccccaccacaattcatatgttaaaccctaattcttaatatgattgtatttgaagatactgcctttgaggaggtgactaaggctaaatgatgtcttaagtatagggcaccaatccaatagaactagtggtcttttaagaagagaaagaggtaccagagctctctcttcctctgtgtgtacagagaggaaaggccatgcaaggacatagcaaaaaggcagccatctacaagccaggaagagaggtcttaccagaaaccatccctgatgataacttgatcttggactttttgtctccagaaccttgagaaaataaatgcatgttgtttaagctattcagcctatggtactttttaatggaagcctgaataaatgaatacagaagcctttaaaaccaacagacttataaggcagagttgtaagctgcctgcctcagtattgaagtcataccccaacatggacacaaacactaccgtcaaaggcagcaatgcttattaatcctaaacatttaagaaaatctttggctggtcagcagttgaccactaagataactgggcaaaaactttggtgaccatacaaagaaaataaaaaatttacagaattctttcctgacaagcaaacaataacagcaacaagcagcaacatcaaactcagtgtggggaatggaaactgactttcagagtttccatattatattattttaaatgtccagttttcaacacaaattatgaaatgtacacattaacaagaaagtgtgccttatatgaggaaaaaaaaatcagtcaatagtgtccctgaagatcccagacactggacttgttagaaagcatttaaatcaactgttttaaatatgttctaagaactgaataaaaacaatcatttctaagaaaatctaggaaaatatgagaacaatattgcaccaaataaagaatatcagtaaattaatataaataataaaaaagaaaccaatagaaattctgtaatgtgcagtaattgaaataaaaacttccccagaggagctcaacacagattagacttagcagaagaacaaataactaaatatgaagatagatcagttgagattgtccatgtgaggaacagaaagaaaaacaagcaaataaacataaacagagctagacatctgtagtacgcccccaatcacacaaacatatgcatcatgagagtttcagaagagaaaaaagaaagaggtagagagaatatttgaaaataactgatgtccctaatttttccaaacattaatcttcacagccaagaagctcaacaaactctaagttggataagttcaaagagagactcttcaaagcagcaagggaaagcaattgataagataccattaataatattaatagacattctcagaaaccatagaggcaagaatagagtagaatgacatgttcaaagagctaaacaaaattaatctcaatcagtatttccatatttcagcaaaagtatccatcaaaaatgaaaaaaaaaattattatcagtaaacaaaaattgagataaactgttgccagaaaatgtattctaaaggaaacattaaagagaatccttcaggctgaaatgaaacactaaacagtaagttgaatccatgtgacaaaataaataacaccaatataaataagtgcacaggtaaatgtaaaatacagtatcaatgtattttacatttacaagtcatttttcccttctattttattttcaaaaaattgtataaagcaataattctacattgtgtttataggcatatgatgaataaagacacaacttgtatgataattacagcacagagaaggaggaagaaaatgaagttatataagagccaggtttttgtatatgaatgaagtcagtgttcatctgaactaaattgttgcaaattaacgtgttaattgtaatccccagggaaaccactgaaaaaataacaaaaataaacagtaaaataaattacaatttattggttagagctacagagaaaaaaaagaaatgatagtgatattaaaatactacagagacaaatatctatttaacagaaaagacagtaataaagaaaaggaagaagaaaaaataagacatttgacaaataaatatcaaattggtatataaaggagaattttcagtaactgtattaaataaaaatgggttaaatactccaaccaaaagggattgacaaaatattaaaacaaaaacaaaccatagtccacaacatgctgcatacaaaatactttagattaaaagatacaaataggttaatagtaaaaatatggagaaagatatactaaacgaacagtaaccacagagctggaatggctatgttactcacagacaaaacagattttgggataaacattaccaaatacaaagaacattatatattaaaaaagcatcaatccatcagaaatatataacaattataaacatacatgcccataacaaagggtccgaaaatacacttagcaaagcatgacagaattgaaggaataaatagacattcaacaataatacttggagagttgaattctcactttcagtaatggctagacagcaggttagtaaatcaacaagggagaagaaggtttgaaaaacattattaagcaattggacctaacatacgtctacagaagcctccaactaacaacagcaaatgattttttctcagttgcacattaatattctccatgatagaccttatgttagaacacaaaacaagtcttaataaattttaaataatttatactacacaaatatattctcccaccgtagtggaatataattactaattattaataaatggaaaattggtaaattgccaaacatgcagaaatttaaaaatatatttctaaataaccattgtgtcaaggaagaaatcacaaggggaattaggaaattattggagatgaaaaacacaacatataatttatggtaggcagctaaagctgtacatagagaaacacttataactaagtatctataattaatagtaactgaaatcaataacataattgttcacctttcaaaactaaaaaactagaaacaacttaacaacccttgctaacaaccttaagcaagcagaaagaagaaaataataagcgtatgagagaaaaaggaatgaaatagagaatagaaaaacaatggaaaaataaaaaaaccagaatttagttcttcaaaaatataaacaaaattgataaatgtttagctgggttagattaagaacaaaaagagattaaccatgtagctggatcagattaagaacaagaagagattaaagttaataaaacttggactaaaagaaggaatattactgctgattaggaaaacaaaaatgataatatgacatactataaataattatatgcctactgattagataatgtgtatgcactgaaaagattcctagaaaaacaaaccactaaaattaaattatggaagaaaaacatctgtatagacttttaacaagaaaatatgtagaattagtattaaaaaaaaacctttcctcgaagaaaagcctggtccacatgattttactgatgaattctatcaaattcttaaagaataagcatcaataatcttcaaactacttcaaaatatagaaaatcttcttattttattctatgaggctagtattatcctgacataaaaaccatacaaagtcatcacaataaaattaaactatacattagtatcccttttgaatactgacacaaacattctgacagaatacttgcaaactgaatccagcaacatagaaaaaaaggattatacaatattaccaagttgggcttatgccaggaatgcagggttggctcattctatgaaaatcaatgcaggtaatataacatacaaccaggctaaggaacaaaaaccatatgattatttcaactgatgcagaaaaagtactcaacaaaatctaacactcttatatgattaaaatataaaaataaaaaacactaaacaatctagagatacaagtaatgtctttaacatgttaaagggcttttgtgagaagcccataattaatgtcaggcttcttgaagactgagtccttttcttcctaagatcaagaatcagacaaagatgcctgcaatgtctgctcctgctatttccatttaatgttgaagtgtatgctcaggccatgacaattaggccaaaaaaataaaaaaagaaaaagaaaaaaaagagaggagaggagaggaggggggaggggaaaggaggaccagggaggggaggggaggtggggagaggggagggcaggggaggagagaggggaaaggaagagaggggaaaggaaggaagaaaggaaggaaggaaaaggaaggaaggagggaaggaaggaaggggaaggaaaggaaaaggaaggaaggggaaggaaggaagaggaaggaaggaagaaagaaggaaagaaagaagaaaaaggaaggaggaaggaagaaaaaggaaggaagaaagaaggaaagaaagaacgaagaggaaggaaaagaaaggaaggaaggaagaggaagttaaagaaaaagaaagaaaggaaggaagaaagaaagtaagagaaagtaaaagtaagaaagagaaaggaaggaagaaagaaagtaagagaaagtaaaagtaagaaagagaaaggaaggaagaaagggaaaggaagaaagaaaggaaagaagaaaggaaggaagaaggaaggaaggaaagaaagaaagaaagagaaagaaagaggaaggaagggaaggagggagggaaaggaagaaaggaaagaaaaaaagaaagaaaaaaaggaaggaagggaaagggagaaagaaaggaatgaagaaggaacaaaggaaagaaagaaagagaaagaaagaaagggaaggaaagaagggagggaaaggaagaaagaaagaaagaaagaaaagaaagaaaggaaaaggaaggaagggatggatggagggagggagggaggaaggaaggaaggaaaggagggagggagggaaaggaagaaaggaaggaggaaaggaagaaagaagaaaggaaggaaagaaagaaagagaagaaaagaaaagaaaaaagaaaggaagaaaggaagagcgtccaaattaaaaataacatttaaaataatatctatttgtagggtacatgatttgcataaagaaaatccaaaataacttacaagagagctaacaaattaattcagccaggttgcaggatacaatatcaacgtaaaaaaacttaattgtgtttctacactatcatgaaacatttgagaaattaaggaaatgattacatttgcagtagcagccaaatagatcccttagtaaattgtgcttaggcagctggatattcacttgcaaaagaattcagttggattttcatctcacattatgtacaaaaataaacttaaaattgactaaaatatctaaacataaaagctaaaactataaacatctttaaaaaacagaaccgacccaaatgtccatcaatgatagactatattaagaaaatgtggcacatatacaccatggaatactatgcagccataaaaaatgatgagtgcatgtcctttgtagggacatggatgaagctggaaaccatcattctgagcaaactatcacaaagacagaaaaccaaacaccacatgttctcactcacaggtgggaattgaacaatgagaacacttggacgaaggttggggaacatcacacaccaggacctgtcatggggtgggggaagggggagggctaatattaggagaaatacctaatataaatgacgagttaatgggtgcagcacaccaacatggcacatgtatacatatgtaacaaatctgcatgttgtgcacatgtaccctagagcttaaagtattaaaaaaagaaggggggaaaaattcatgaccctgactttgacaaagttttcatagatatgataccagaaatacaaggaacaaaagaaaaaaaatagatatgttgtgcttcatcaaaatttaaaacttttgtaaataaaaagtcattaacaagagaataaaaaggcaattcaaaacatgggaaaatatatttgcaaattatatatctaataatggactagcatccagaatctataaagaaatcttaggactcaacaaaaagagataaacaaccaaattaaaaatggacaaaggctagaatgaatgtttttcaaaataagaggtaatgaatgtcccacaaacaaattaaatgatgttcaacatccttagtcattagggaaatgcaaatagggaccacaataaaatgccacttcacacttgctaggttgctcagaatcaaaacaatgaaaatataatgcatatgatcaagcatgttgaaaagtcaaaacccttgttccttgctggtaagaatgtaaaactgtgcagccactctctctggataacagtttggtagttcctcaaaagttcaaacataattttcgtattacccagcaattccacttctaggtacataccaaaaagaatttaaaatagttacggaaatgcaattgcatatattttcatagcagcattattcacaatggataaacgatgaaaatgcccaaatgcccatcaactgatgaatgaataaaatgtggtatattcacacagtggaaagttatttagccataaaaatgaagggagtactgataacgtgctataacataaacaagccttgcaaaaattgtgttaactgaaagcagacctacacaaaatatgattccacttgtatgaaatgaccagaataggcaaatgtatagagataaagagcaagtagctaatgtctgtggatcggcagagtggcgagtgattgtttaataagtgtgggtttcgtttttggagtgatgaaagagttttgaaacaatgctgttgagggtcacaaaacattttgaatatactaaaaaaccctgaattttacaccttgaaatgtataatatataatttttttcccaatgagaagaaataaaaatttgaaaacatcaacaaaaaattcctgactattgctaccaacaatagcaataaattttcagctataaatttaccaaaagaaaatagaaacactaaattagtagaaagaaaaattaaaatgaggaaaacagtcaaccaagttctcttagtgctttggaattacctaggaaagtaaaggaaagagatgcctaaattttaaccttgtatgtggttacacttttctgtcattggagtttagatggcactggtaagtaaatcaattgggcatattgatatgaactccaaaatatttaaagccaactttcgataaaagggtaaaatcagagcattaatacagatatggacattttaagggaacatgaatattgatcaaaatattaactgaatatataagtaggggaaattgattttgttacactgtgaggagggtggacaattgaatctccactggacaaaacattgtctgtcagtgacctatgacttatagcatataaaggaactcaaagacaatgaaagtctagtatcaggtaacctgaagtggtgtcctctagaccagataaatttttctattgggacttctttttttctacactattctacaacatcaaatagaaagttagacttctttctaaaagagggttcagccattagagtgacaaagtgcctatcacaaacatttctagccccaggcctgatcaggggccaccaatgacattcctaaatctaggtgtcagaaagcctactccctaaccaatgaggggctgacacatggagatacaattgttaagacagaactggcatattgagaagcccggggcaactgaaaaatcaaagtgggacaattggagcaaagaccatattagagagaaggagccatcagagtttctagaggagtggaaattaaatctgcttctacttcataagagatgatctgtaagttcctagtgagccacatggcctgcctcctgaagaagaatcattatgcctagcacttgagctcccaggagggtttttcttgctgccaatctcaagcaaatgaagccactatcctggatttggcaagaatggaagctcacaacccctgcagcaggatgtgtagacatgacagtgcaaaataatccgaagattggctgcctcttgagggatataaccatttctctggttaatgaacttctgatccaggaaaagtttctgatttctgggtcctggagctttgggggaggcctcacagactcatccagtaagtactgtcaaagagtttaaatatatgggcttgcttctgactcctcacaattctagtcttctttaattggaagtatctatgagacatctgtattagtccgttctcacactgctgtgaaaaaatacaagagactgggtaatttataaagaaaagaggtttaattgactcacagtttcacatgtctagggaggcctcacaaaactttcaatcatggtggaaggcacctcttcacagagtggcaggagagagaattgcagagcaaagggggaaaagccccttataaaaccatcagatcttgtaagaactcactcactttcatgagaacagcataagggaaccacctccatgatctaatcacctcccacgaggtcactcccgcaactcttggggattacaattcaagatgagatttgggtggggacacagccaaaccaacatccaagcaaagatatcccaaagagatctggagggttagaaggtggtggtcctgtgaggtgttcgaatcagtaatgtcagaaaggaacagtttcttatggtgacacttgaggaagtggccttaggtaggaatgtctggctgaggtgtcaggataaagaagaccacctcattggccctgaggaagccaaggtcttgtgaggccaggatgttggctggaggcctctggggtgtgttgaatttcctagagtgatggtagtaactgaggtagaactggagatcttggtggacttgctaacaactttatttagtatagagaatatctacaggtaagaaggtgttggcaatggggatgaggtggagaaggcagcatcgcagttggcatggacttaaatggggcaggggtttttacatgaagattgaagggtgataagtgaaacaaaaaagaaatacatagaaaagaaagaaaaggaattgattccaaatacatattataacatacgtgttacggactgaactgaactgggtatactttgttatggcaaccttgctaactcacacagattctggtatcaaaagggaggattctgctgtaacaaataaccaaaaatctagaagtggctttggaactgggtagagaaatccatctcatttggatgtatgttacacaaagcctaaattgattggaagagagtattgttaaaaatatagatgctgaatgtgattcccgtgagtcctcagaaaattagagagctgtagagaaatcttctagcatctcataaaaatacatgtacagtcattaacaaaatgttgctagaaatatgtatgctgaaggtgcttctggtgaggtctcagagcttaggaatatgtaattgaaaactggaggaaaggagattcttcttacaaggtggcaaggacttggctgaattgtattctagtgttttgtggaaaatagatcttgtaggtgatgatcttgaataattcactgaggggatttctaggcaaaatgttgaaggcataacttgatttctcttcgcttgtatggtaaaatgtaaaaggagagatagattgaagaattgtcagcaaaaagataccagagcttgaagatttgagaaaatctcagcctatcaatattgcagaaaataagaaattgtgtcctgaaaaatatcaaggatagggctggataatgatttgccaaaaaaataattataggtgtgtgacttatgattccaatcagctgtctcagctgaaaccatgaatggagatggggatttataccagtagaagcactgtcaggttgactgaaggagagaaagatgaaatgaaatgaagcaaggctgttggactcctgggattttatagcatgggctaatacagacacgtggttgtgaacatatgctatctttcatgaaaaaggaatggctgtgaaggcagttcagaggttgttggggctgccactgtcaacgtggatcctcaggtctgagagttttggggtagtgccaccacactggtgggcccaaaaggcagcgttaggactaggatgggctctgaggacacagcatggagtcaaagaggattattctcaagcttcaaaatcctatggaattttccttgctaggtttcagacttgcttgcaacctgttacccctttattcttcccaattgctcccttttgcaatgggaatgtttacctcatgcctattgctctaagatgaattttgtctccccaaaatccatacatcaaaaccctaacccccaggatctcggaatgtgactgtatttggagataggtactttaaagaggttattaagttaaaaagacagttaagatgagccctcatccaatcttactagtgtccctgtaagaacaagaagcgagccaggtgcagtggctcatgcatgtaatcccagcactttgggaggccgaggcaggcggatcacaaggtcaggagattgagaccaccctggccaacagggtgaaaccccatctctaccgaaaatgcaaaaattagctgggtgtggtggtgcgtgcctgtaatcccagctaatcaggaggctaaggcaggagaattgcttgaaccagggagtcagaggttgcagtgagccgagatggtgccactgcactctagcctggtaacacagcaagactctggcaaaaaagaaaagaacaagaagcttggagacacaggaaggtaccagagatgtgcaagctcagagaaaagaccatataagaacacaacaagaaggcggccacctgcaagccaaggcaagaggcctcagaagaaaccaaatctgcaaaaacctcgatcttggacttctagcctcaagaactaaaaaagaaaataaatttctgttatttaatgttatttaagtcacccagtctgtggtattttgttatggtacccctagcaaactaatacacctaccattctattttagaagtagataactcatcaatttcacaggatcacagctggagagcaattttgccccaggaatcatgactcaagtctcattcatacctgatttagacagtatttatatgagattttggactgagatttgatgttgcaatgagttgacttttggggctgttgggatggtgtgaaagtattttgtatatgagaagacaatgaatttgcagagtggcagggggtgaagtattatggacagaattgtgttctcctcaaattcgtatgctaaaattctaaccccagtaccttagaatgtgactgaatttggaaatagggattttaaagaggtaattaagttaaaatggggctgtgtggacactaatccaatattacttgaatcctcataagaagaagagaatagaaacacacagagagaagaccatgtatggagaccagaaaaagatggctatctccaagccaaggagagaggcctcaggagaaacaaccctgctgacaccttcttcttagactaccagcctcctaaatggtgagaaaacaaatttctgttgtttaggtcatccagtcttcagtactctgttgtggcagtttaagcaaatgagtacaatgggtgaatcttgaaaacattatgctaaataaaagaagtcatatgcaaaagaccacatactatatgattctgtttatataaaatgtccagaaaaggcaaatccatagacttataaggcaaatcagtgggtgtcagaggcaagggagtgagcacttaggagtgagtgctaatgggtatggggttcctttccaggatatgaaaatactctggaattatataggggtgatggttgcacaactctgtgaatgtactaaacactactgaattacacacttacagaaacaaattttatgatacaatgtatctcacataaaaaaatgaaatcacagaatttatagcttcaaagttcacagagcttaaatacttcctctgacgactgctgcttggttaagcaagaagcgttgcacccggtggcttgatggggtctgagccattcccctttgcaataagaatagctccttccatatctccaaagtagatctgaggccttgccacacaggtgttccacttttctaaaattctagtgaatcaaaaagatatataaacatatcttaaaattctcagcaaggaaagtattttatccatagcaatatgtttccagaatccagtttacattacttacatccatactgctgttacaaacaaaaatcagtaacagattcttacacatttacataaagaaattagaattgagagaattagaatggagtaagcaagttgagtctcttctgttcagcattttctcccacaaggatgtctggcattccagacaaattgtctggagaaactgttacctttaactgagttgggataattctcccatccagtgtcttttgtttagctgaaggattttcctaaccctatcagaggcccaagagcaacttagccccttcctgctgctgcagaccttccctagactgggcattgatctttgccatatgattgtcccctaaattgtgaagaagggtaaggcctttagccttgtgctgtctctgtttttggaacatctcaatctacatctttagaggaccagagagaagctgtgaccaccctctcctccatcgttttttttcttttgttaattgttcttattcctctggttttattttatcttatctacatcaccaatgacataaaaagattctttcaatctcaaatgttcctgctacaacaggattttgatttgatgctcctcagcactggctgagaaaacacaatctgcagcggccacatatattccccaaagctctgcccttttgagttgaaccccaactttggcctctccatgtgggactctgtctaaggaatgaaaggttgctttgggagttcaaggtctccaaaagcatctctcctatcttcccccaaattttctattcaagccaagaccaagtcataatttgctttgtctaagattatgaacggaccttgtcttacccacaggtcgattgtctttgataataacactagttatagccacactggataactcaaactatcaacataatatctgccaaaacaatcatggtactttattggtatccatagagtttctttcctcatgagatattcagaacccgctggctagtacctgtgcaaaacttactctattcctgcttctacattctatgaacactccaaagtggacattgctaatcagattggtcctagatatggagacgagataattagaagagggatcccttcacttgaggacagaagttcgagactagcctggccaacatggtgaaaccctgtttctactaaaaatacaaaagttagctgggtgtggtggtgcacacttgtaatcccgctacttgggaggctgaggcaggagtatcacttgagcttaggaacagcgagccgagatcgcaccaccgcactccaacctggatgacagagtgagaccccatatcaaaattaaaaaaaaaaaaaaaaaaaaaaaaaagaagaagaagagggatctctgcattttaattgcattttaacttaggctccctggctcataattttaaacttttcatggaagacttaacaagttgaaggtagcctttcttggaattgtcacctaactttctctttttctttatgattcctgtggcttggttgtaaacggacttgacatccatattggcactagctgggcctctctacagacacacaggcagagtggcaggcccttcttaggcgtggaatatgagccacagcaattcagcatttgaccagagtactgcatagagttctgcagaattattaattatttagtgaacattttgctgttatttcttctgataactttttttaaaattttggaagaatgtatggataatcataggttaaatttgtggaaattattggctttcttactataacatcattgtaatattccacaaattaagggatttcctacttgtagttgcaatattctataagctattattagcaattttggcctggacaattttgaaaaacaaaatgaaacaaaaaaacaaacttgaccaacaatgagaattatagtaataaagaactatgtgaatatgtatatatatgagtgtgtctctatgaattttaaattaaatttggctaaagaaaccaacctgtgcaaaacttaagctctagcaatagcctcagccttaatatttaaaagacacttaacggaaatttagcaaaaagctccagccattgaggacaattttatcagatgcccaaaatgtggccttgaagcttatctaaaacctgctcaaaaaaatctgatgaataaggaatatggagaactttcaactgggaagataagacatgaagataaacatctgtgacttaagaaagacgcaatgtcagctactatggaaggaccaaggaaagtgacacccatgtaaagaaaaggcaatttgaatgtgaagacaatggggttgtcatcacctcatgtgaaagttagccacctactagcaatgatctggaaggaacaaaacaaatcatagtcaataaatgtgcaaagataaatattgtgttagtaactatttgtgcttttttctcttgtcggttgtccaaggtgtcttagcttcaaattaggatagcttatgacaacatggtggcagattggagtaggggaggatatgcccataccaggaggtctggagctgaggattctgactttatcgaagggctaggcttcaagatggaagatcagtagtttttgtttgtttgttttgtttgttttgttttgtttttttgttttgttttgttttgagacaaagtctcgctctgtaacccaggttgcagtgcagtggcacgatctctgctcaccgcaacctccacctccctggttcaagtgattctcctgcctcaaccttctgagtagctgggattaccagcacacaccactccacctggctaatttttttttttttcatttttagtagagaagagtttccatcatgttggccaggctggtcttggactcccaacctcaggtaatctgcctgcctcagcctcccaaaatgctaggattacgggtgtgagccaccacacccagccgatggtcagtggttttgtaaacagtattattcaaatgcagatagtaagtttagttgtgatttacaaccatatgatatataaggaggttcaactctgtaggatacccaaaacaagagtaaactgaatgtaacagtgttttgtataagtcagggataggggtctctagtgaaaagtacattccaagagcatatagaagcaagtttcactcatttgaaaagatgctttattaaaattaggtaaagtgatgggtttccagttataaagggtagggttggccaaatatccattttcagtaagaatctgaaaccagtgggtatggagcaacgaaaatctaaaggtcaaaccaagatacagagatttagccaacatggcagggggtaatgaaaagacctacaattcatggccaggtgtgatggttcatgcctgtagtcccagcatcttgggagaccaagacgggcagatcactagaggctaggaattcgagaacagcctgatcaacatggtgaaacccatctctactaaaaatacaaaaattggctgggagtggtggcgcatgcccgtggttccagcaactggaggctgaggtgggagaattggctgaacctgggacctgggaggcagaggttgcagcaagctgatgtggcactgctgtactccagcctgggctgcagagagagacactgtcaaaaaaaaaaaaagacgaaaaagacgtacaattattggatatatgtgtatccagagtttaccctaactactgcagatactaagcctgctccatagccacccagcaaattacaaaactaatgagtggagcaagacttgggagttgtagctgatcttacacagtgcctttagttaagtgcttcatgttttctagatttcctggtttcccaagttacttgtcaaataagcttaaaaatcatttacgtaatatttccatttggatggatttataaagcatattatcctatagtaaataacaataaaaaaaacactttgcttctcccaattctattatgatctgtttttgcccacaaaacacttctgacaccaaatgtgtgggttttgtctacaccaacaaccagttcttcaactaactctccagacatcaagtgggtgttcaacaattcagttcaattctgatgctaactttagaacccagaggtgaagggtgcagtcccacaagactgctcccacttgacatgaccactgcaggtcctggatttctcatacttctgactgactggctataaattgggagttcccacaaccccctccttgggttctataatttgttacaacagtttacagaactcagcagaccagtttccttactactggtagtttatttttataaaggatataactcataaaacgccggaagagaaacatagggtgaggtatgagggttatgtgtgaagcttccaggccctctccagctgtgccacccacccaccatctccatatggtcaccaaattggaagctctgtgaactctgttttgggattttattacagtttcattacataggcatgattgattaaatcattggctgttggtgattgattcaatctctcctgccccttttctgaccccagaggttagggtgaggttgaaagttccaaccctctactcatgtgcttggttcttttggtcaccagcccccaacttaaagctatgtagggcccatggaaattcactgccttagcataaactcaggtacagttgaaagggctgactatggatatcaaaagatgtttctctcaccgccaccactcaggaggttacaagaattttagaagcctttgccaggaacctgggacaaggactaaatatgtttcttattatattacaatatcacatacttaatatattataccaaagcaatgtattaatatattgcaatgtcaatgcattttcattacttaagaaatgaatccttggaaaagtactttgaaagtcttgctttaatccaatacatttgtctcaggaccagagatccagcaatctgatccagaatatatccaactctgaacatccttttccaaaaagtattgttcactctattttctgcgttgctgtctagtgtctgtccttgatccctttagcctctactctaagcattttctttcctagagaaggagctgcccagactcacttatttcttactagcctttgcacatactattcctcaccacaagaatgcctcatacttcacacactctccccacttaatttgtgtgaagtcctcctcctagatattcctagctctcttttgtttgtatttgttgagcacctattttgtgccaggttctaggtgtttgggttacatctgtgaacaaaagttctggcgttaacatctgtctcactagatcctgatgttatacccgtctcattagattataaagtatgccctttgcttacctagttctcatgtttaactctagctctgtaagaaaagaatccatccaattaggtgaaagtattattcctgaagcccagcatagtttttggcatgtcttaatcattcagtaagtgcttgatggaatttaaaaacaatcacattatttcttattcatttttttctttgtttgctacagttgcatctatcaaaatcctatctgggaagctgtgtctaacatatccaaataatttatagtgcaaacctcaacagaagcttctacagttttgccaagttccccttggccatctctcagttttctaccaaaaatgttttctgttatctcagaaatattttctagagttaggaagagtccagactgactcatttgaattaagtcctccctttgtcctggttggcttctatgactttgagaaacttacttaacatttttgagccttgctctctttatttgcaaaacaggaatgactatggtaacctccagaattatgctaacagccaaagaaataggagtggcgcatacctcgcacagtcgtgtgtctgacatatagtagaagctctataaatgttagtttcttccttctcccaagagagggacttgccttttatggaaaggattggggaaagctatatgggaatgtcaaattttggtaagaatgttaaatgaagacattttaaggtgcaaattttatgtctcccttagctgagctttcattattcaaaggactgaacaggagtaacttgaggtaaaggcatcatttaaaaaaattactgactttatctacagaggctctttcacttgcttgaggtctgtaattaagacttgtctgaataagcactagtagtttaatcgaggtataagaggaagaagatgaaatgcagggaagatggagcttccagctttcttcagaatgaaagattactcactttagagaacagagtgagccttcaaaaactgcttacaatgggaaaattttaacattttcttttaactacacaagtaacatcaatgtgctaattattctaaaatgagctcagaatttgctgtatggttacactttatgaaatacttgagctccattacaccaagaaataaaacgctgcaaattcatttctgttaattcatgcataattgaagaaagggttggtgtgaagactctagaacatgcatatttttgtttctttgttctcactgccattatagttgaaggtttacaataacaaaaaggggtaaatacattggactcataacttttatgaactgtttaaatgcacaatgaaggtgattcataaaagtctctaattgtataagcacatcactaaatatggattgtaaaatatcttgtttactttttatataaacctactatagatgaaggaatattgcaaacatagcatgtattttgtgcagaatggagattggatctacttttaagaaaagtggtcccacatcattgaggccaatttttcttcaattcctttttaaccaaaatcagaaaaatcattctggtaacatcttggtaaatataaatgagggccatgtttagctgaacttcttaattaaagctttaagctaaaccacatttataataatagctaaaagagaggttttgaatgtcttcatcacaaagaaaagataaatgttcaaggcaatggatatgctgattaccctgatttgagcattatataatttatatatgtattgaaacatcactttatactccataaatacgtacaatgattacatatcaattataaattttagacatttctgctttgaaaatcttgttaaaatgtttgaatcaagcccctgctgcccctaggccccaccttctagataaatataacatactattatgattagatcattatttgtcttgctagggtttttgtgtgacattaagaaagtcacaatagctattatataatgatcaggtagtttaggccaaacatatttgtaattacctgttctcctgtatgcctctccaaccccaccccctaccttctagacagtgatccaggaatcaacttcttcaggcatatatcaggtactggaggcactcaggactgttcatgaatgattttttttttagttcatttgtgaataaatacatggtgggagaaatttacagtaaacatctccaatcccctgcaaactctttgtggcagcattaactaaaaaagtctgagtcatctagccattgtaacactgaggagaaataagaggaccgagttccacaccaggtcttcgagatctaacctgagttgtttccagtgctcaaactgtgctacaaccccacctgcccaaacaggctcactggcttggattgcaggaaactaaaaaatatacaggggatgaggggttccatggacttgcaccaacctctgaaaggtgggtttctgggtccagataaaggtaatttttggtttgcttccaaattgttttttagcaagtatctttggttagtggaggttgtggttagtttctctttaattggtgttttctccacctcaatgcctgatacttgggattctatagaccaggggagactctggggcttataggataacatcaattttgagcatcagcctagcctaatataattgggatgggtggggttcttcccaattagcaaccacacagatgactgaaattaaagttggtggttagaaaagtcatgcctagagagtaaaaaggaaagttcattagtttttgtagaggcaaagggagaactgcccattggtcctctgaaggttcactgaaaatcaactgacaaaaggcagattcataggaggaaaggtatagaaatgtactaacacgcacaagggggaaatcccacagtgattacctcactacccaatgaggtagaggtccttatataccctcttcctaggagaaagggagatggggaagtatggatgattttgaggggttagtaaattatctttaggattatcaatggatttgaaaaacatacaatggcctgggacaaagtccggcgggcccacagaatagtttgtgacaaaagtctgcccagctgcgttgacaagcttcagtttttcttcctgcgatatgagattcagttaatgaaaactcagggaagggaccagaagtcactgtcaccaccttttggtggtctggaccttaggcagattaggacactttagagaacgattttatcctgtgctttggaagagagagggtggagctggggagggtcacagagaccttgagcggcttcttcagttcagcaagttgaagcgccatattttggggtataggtttctgatccccaatgccttcttcactaaagctgaatgctttggaggggaacatgttccagaagaaactgtgtaagtttgggagtcagacaaaactagatcctaatcctggtatacccatttatcgactatataactttgagacagttacttaatcctgctcaacctcagtttctgttctgtataatggggactcacacctcacttgtgaagttgggataaggaatattacacatatatatgatatatttgaagtacctaaaccataagttttgtctttaaactctggctttttgcacatataggttgtctgaattcttggtggaacttacagaattatcatcatttgaggttacagccatcagaacttcacaataaactaaatatcatttttggaggaattatacataattaaaatatttgtagcctgcatcatcagtggtagttgccaagactgtgagagatgaagatatatatatatatatcttcatcttgtggcacctagaaccaactaataagcccctagggagaatgctaaatggctatgatttcctcatgccctggagttatagctgaggctaaattacagctgtagaaaccgaaaagctggaaacagaagccatcagcccagcatgctcttcccaaggcactcggttctggaagtctgaaggccctggagtggagctttaagccacacttggactaagaaaagggatataatttgtgaatgccctaaacattgaaggcttttattatttgaacgctttgattatttgaaggcttttattaaaatttaaaaaacacaattttcaactaattaatggattagtttattttatcattcagaaagcagtataaacctgtgtatataaaaagtctccttaaatttatcctccatgtttttattggttttaagcacataaatacataaaagtgcctacacggcatctctccccttcaaacatagattgcaatacttatacaatggtaaaagttggatgtatacctttccagaaatgtatgtaatggaatacacagagagagagagagagaaagagagaaagacagagagagagagagagagagagagagagagatcattctacatatattgttctgtcatgagttttgtttcataatacatgtggacaaattaatacataatggccttttcattctgtttattgcttatataatattctttgcacagatgcattatgaataatttaaacattcttttcctgatatacacgcagacttgacatcgtttgttattttggctaagtccaactctcctgcagtggatattcttttatgcctttgcatgcattctggggaaagactgtttgaagtagttactaaagggtgtgtacaaattgccgtccaaaaatgcatttttatccacaatacatgtcttctcattcttaccagctctagatgttttgttttgtttttgaacttgtcagtctgaaaattaaaaatggcatttaattttactaatatttgtgtttttctaattactagtgagcttgagtatatttaatatctttatgtcgtggaaatgaatttactgtcgagtgagctttcctctgatccatgcccacaatatgaaaaccagtttctctgattacaagaaaacagaggagtatgtgtgtggcctggtgtgtgtgagtgtgtgtgtgtgtgtgcgtgtgtgtaacacctactgcagataagcaaggcctcgttggcattttcattgtgtttgctctgggtattcatttctgcaaaagcacacctttttctaaataaaactaaattcatcataggtcttttatttctaatttggaaatattttagaatttctcaaagtatcataaaataatttagaaattattttagaatttctcataaataccattcaaactcctaaagaatatggagaaagatatattataaaacaagaacttagaagctctactttagaggaatttttaagcatgaaatcatgtctagttcccaattctaaaaaatagcccttgactcagtcagcccacagacattaagcatttgtgacatgccacaagtaggctggtatggagattcagaaacgaaggggatattctctaccttcctggagccctccaggggaggaggaagtgaaaagtagagataagcataatacagtgcctgaatgctataaatattgagtgtagtggcaacccgaggaaggggagtgtttgggacctgctgcctgctttattgtctcttgtcacaggaggaaaaataattttctcctgtgacaagagaataaaacctcaggaccttccaaatttactatgccaagggggaaagttaaaccttgaaaacgggcttgcataacacaactgtttttcttctctggttcctgactactgcttactgacctttgcgttgagactttataccttgaccagactccctgttcttcattcaaacctagactagatgacatgaagatagagacccttgtgactattaccctttatgacagaatgttaagcaagccttttagagtgtaatcaatagtagccaatcaaatcttatatctgtatgttagcctttgtacggaaaatgttatagttcagcccctccatttttgcttatagaaacaatcctcatttttcccccacactaggagcactgatcactattctttggtgtaattctgctcccttgtcagctgccctacctttgtgcttgagtaaactcttttaaccggatgctgagccttttgactgttttatgttggcattcgctacccttcatagttcttagctgggacaaatccctgtaacaaaagaaagattcacaagagaaaaacaaacagaagtttaataacatgtatacttcatgtgtacatagaagatatccagggaaaatgagtaaatctcaaagaagtggcttaaatttaggcttaaatgccatcttcagctgaaatgataagagtatttgggtaaggagcagttaatgggaagatgaccacagaagcacaggaagcaggataagttttgttatgcaggttggtccatgtcttctctatagatgagcgtttctagtgactgagagtcatccttcccttcctgctacggagaagaagacattcttacaaatggatgtttcctttatagatataaattgctcttgtgaaaggacaacttctactgttttcagagcttcttttatctttgctgttgcccaaattaatcagttcaaaataatccttatgctaaagaggcatattttggggtggcatattctggtctcctacagtcatattttgttgtggtacatactaaacaccactactccgtaacagctcatatgctgaacaccactatgcagcaacagctcatatattaaataccactactccataacagctgtaaaattctgtctaaaaagaaatctgctttttgtgggtgcatgtgtgcatgcttgtatgtgtgtgtttgcatgtactaaacatttattgaattcgctgatctacaaaatgtatgaccaacttccatccagaaattttaataagattgcaccataccaaaagccagagaatcaggagatagattacagactatgctgtaattcaactacagaatacagaagtagaggggattaataaaggctaaagttggatgggtgtggtggctcatgactgtaatcccagcactttgggaggccaaggctggtggatcacctgaggtcaggagttcaagaccagcctggccaacatggcgaaaatccatctctactaaaaatacaaaaaaattagccgggcctggtggtgggtgcctgtaatcccagctacttgggaggctgaggcaggagaatagcttgaacctgggaggcggaggttgcagtgagccgagatcatgccattgcactccagcctggatgacaagagataaacttcatctcaaaaaataaataaataaataaataaaggctaaagttccacatttgcaatgagttgctacaaccagcaaaaaaattaaggtttttttcagatgctagcagtcacagaggtgaaggtgcaggaatcagaatggagagatcattaggagcaaagaaagcaggcattaagatagaatgaatcaccaaagctgataacacttgaagcccctgatttcaattttaatgattcctggcatggttgaaaatagttgacatactgttcctctattatatttgtgttttcctgctgccttcactctttcagacagagggagtagagctacaaatattaaaagaaaaaaatttttttgcagtattttaaaaaaagctaagttaaaagtgctgaacattttgcaaaaacttgtccttgtcagttctggaaactcaagggttccatgtaattcgagtaaacaaagaacacctttcactgacactttctttctttttttttttttttttcctgtctcactcattccagtaacattttggtccttgcattcctgaacatcttcctgggaacccaccgtttcttcttattactggtctattgctgtgctttataaaccccttaaagaagctttgaacactctgaagaactgaataatatatctcagaggaaaggtatagactaaattgactactgcaaatagtttgcacagaaaagtaatgtttggaaaaatagattggggtctcagtattggggcatggaatgtttggttgtggagtttagagcttattgaataggcctcagggatacacacttaaaaagtaatgctttggtgagattaatcagatgtaaacctagagaatgactgtaggatggggataggagaagatgctgaagacagactattacaacaatatgtgttatagaaatattatataatactacagaaatattgcagaaatactattgcagaaatatagaaatgtgagttgcaaattcatatttgaaatattgtcgaaagggaagattaagaacacatgtagagtcataattcaatcattaagctttttatttgacatttgtgttgcatgatttgagaagattcaaagatgtatcaagcctgttttaccctgtaacagcttctataactaattgaaacttttgtataaaatttattcaagcacaacctgctgaagaaagctttctctgataccatgcaacattgagagtgatgctcagcttgatgctttcagaatcttggtggtttctatcatcaagtgctcttcacactgtaatcatgatctctttatatgtatactatccactttacacggtgaggcccttgaaggaaggaactatgtctcatttatgtaggtacctcagagaaagtagtgcagtgcctgcaacagaggacgaatcagcattagccaaaggaatgatggctgcaagtatgggaagaaacacaattctggtacaaagtgttgtcaataccgttgggtaaaaaaagtattattgcttgtataagagctgggcaagtgttggaaaaccagaagaatggtaatttttctgtgaagaaattgagttcatttaattacatgttgcatgtgaagagatatttgctgtctggcaaaaatgtaaagaagtcaagtcaaaagcacagcactatcaaggacggaaagctctacacagatttggagaaggaaaattaagtgttagatttaaagaaagaagaaagggcctaaggaatgagggaataaaggagcagcattaaaaatcaaagagattaaaaatatgtaggaagttgaatacaagataaattggactgtaaaggtcagtttggagacagagcaatcagaggattctggagaccaatttcttttcttttcttttttttttttttgcgatggagtttcactcttgtcacccacactggagtgcagtggtgcaatctcagctcactgcaacctccgcctccaggttcaagcgtttctcctgcctcagcctcctgagtagctgggactacaggtgcccgccaccacgcccagctaatgtttgtgtttttagtagaaatggggttttaccctgttggcaagcctggtcttgaactcctgacctcaggagatctacccatctcggcttatcaaagtacagggattacaggcatgagtcactgcccccagccccagaggccaatttttacgcagtgttgatcttatggcattgggcacacctgctgctcaaaaagatatagcaaccagggcatggagcgtcaatgtagcagtctagagagcagctagggttgtagaagttgcttttcaaaggacagtcccagatggatttatagatgccattcagttattcattattgcaacattttttaatgtttattggctaacaccgtttgagaaactgaattggctttaacacatttttgctaaataaatgctagatgctttgaacattacacaagtaagatacatgctctataactctaattctaagtaaaacatgaagattttaagggacagagaggaccagttagaacaccatgaaaaggcatcagttgatttgatgctgaaagataaataacatcctagcaaatagaatttgggaaaaggaattgtgaaagagaaatctagacatcaggaaatgcaggaatagacattttataccagaaaatagtacatgtgtctaagaaaatggtaggagttctgtttagtaaaataataggacatgtgcgtaacctccattaaaatgaagattctattggtgagatactcacttcataccaagtgaaaggccgatgcagttcaaggttgataaatgtacataataagtaagcagtcattctgcacacatttatgaaaatgcccttagagaatttatccctctcccatagctcgtcctgtgcttttcacactgagcctcaattttattcacaaagatcgtgataaaaagcaactagtggaactgaaagtcattaaatctgaaaacagccttggaccaggtagagaaaccaggagccagccaggctttccttctgcttaacaatgtgactttggagatacttgataagagaattctgagtatcaatttccccatatgttaaaacagtattgagctaaatgatagcttcaattctttctggccctgaatagttgtaagtttatttctgttttttgttcacatttgtttaaagacacagaaagaaagtgcatgatctggacaaagcagtaccttctgatgatgttttctttcccccagatgattcatataactacataatgggatatttaaaaacaaatagaccgggcacggtggctcacacctgtaattcctgaactttgggaggccaaggtgtgtggatcacttgaggtcaggagtttgagaccagcctggccaacatggtgaaaccccatctctactaaaaatacaaaaaaattggccaagtgtgatggcaggcacctgtaatctcagctacttgggagggtgaagcaggggaatctcttgaacccaggaggcggaggttgcagtgagctgagatcacaccactgcactccagcctgggtgacagagtgagactgcgtctcaaaacaaaacaaaacaaaataaaacaaataaaccatgataaaaacaagtgacactagcatcctataattctatagattgagtaatgacatagtaacaaattcactattgcagaactggggtgggagttccactccctgggcaaattaaatccacccaagtcatcagacctttaattttcattttaaagtgagaaaatacacaagaaatcatctaaaaatataattacagggtgaaataaataaggcagagtatgtgtgtgtatgtgtgtattttaagttactcttttcagaataaatggctttaggaaattatttttgtggaatgagtttctctactatcaaggagacttccctctactgtattcaaatttaggtaaaataataggtaaaagtgcatattccagtactaaactaataagcaatcagaaggaaaaatagatttcagccgttatgcccatagaatgaatttgattgctgaaggtggtatcttcaggatcctgttattgttacttttgctgaaataataggccagattttattttataaaagaaaactatagatttttcttctaagttcagacttgccagctagttctactgttattattctgaagtgcataaagtcctcattaactgatgccagctgaccgggaagcacgttgatagatgccttcttactggtggggaagttcacttaacatctgtacttggacgtgcaggcgggtgcttggcaggtgacagcctgcaatgggtgctgtcatgctataagcaagcaggctgcagagccagagtttagcttctgtttagctctctttcccagcataatgtgtgcaaaacacaagtgatgaaattgatgcacagcgctgtgtgttcctacaccactgcattatatgaataaggaacatggaacaaaatggcaacattaagggtatgtcagattatttcgcagaaatctgttcctttttcccctgcagtcaaacccacagcattctatctcagaaatgaatatagaggattctgttagattttgccttgaggtttgtatttgtcccaaagagaaaaggagacttatttagaggactggttgtgcagagttgaggacattagcctttctctcaggcattatgagatgtcagcatgattctgcaactcggacttcacaatatcaagtgttcgcatatttctggaaaatgtgaaagtaggcagccagaaagttatttaaaatatgaagaatttacgtgaaaatttttcttgggtccaaatccaccaattggttaaaaggtttacccaaactgtgtgcatccagatattccactgacaaatatccattcattcactcatttatacattcactgcacaaatatctattaaatacctggtacaacagaaaaattaagagaaagtcctgcttttatgaagtttatattctagaagatccttgtgattttagcatttttataatttaaacatttttcatagatttgctgatatgtttggctttgtgttcccacccaaatctcatcttgaattgtactcccatcattcccatgtgttgtggaagggatctggtgggagataattgaatcgtgggggtagtttcccccatactgttcatgtgctagtgaataagtctcaggagatctgatggttttaacagggggttctgcttttgcatcttcctcttctttctcttgctgttgccatgattctgagaattccccagccatgtagaactgtaagttcaattgaacttctttttctccccagtcttgagtatgtctttatcagcaatgtgaaaacagactaatacagttgtatacctacacacacacatgcacacacatgcacacacgcaaaggcacacctacacgtagtgttttcatcagctagggtcttaataggaagaaataacagaaataggaagcaataaaaaaactgactgcagtttgtttaaactaaaaacaaattgttgaaagggtattgagtagttcatagaattgtagagaatgctaggtaaccaggtttagatatgaggcaggaatatagaaccacagccagtaaatactacagagccagcaagggaagactctgccatcactgctgatgaacaaacaatattgtagcttcaaccctggagactggatgttgccactgaaaaccataagctcttgcatctgggctttcaaagttattgcttccaatctgcctgtttcttaggatcacagactatgatgcaagtctcagggaggcaagtttgattggttgggcctggtctgagtgaaccaaaagttgagtcttagtgaaatacacactgcatttggtcaaatgtcagcggttgtgaaaaaggtagctacctgcaccctcatccccattttattgtatcttcatgagacaggacatgtttgattttacctctgtcatctcagtttctagcataacacaggccacatggaacatatttattaaatgtaggaatggaatcatttattaggtgtggtggtgaaggtagctttatactcatgccacacatttgcattttttttattttctctgaggtttgagttagctcctaatgctttacctaggtttctaaaggcttagactaggatgagtctttggtctcttccagatcatatcaggattcaggggcctttgagctcctttgagagataactgagtgttgagtggactctgaaaggaatttttcatccagggaaagaagtccacagaggaaacaaggcagagacagcagagctgctgctgccggaggcctgaaaactatcaactctttctgactctcctctgagactgggcaacaagtgtgggtccacaccattcttgtaactgtttaggatgggttatgctgccctgaaaaattcaccttgagattcagggtggtctgcatgggaagaaaagaatggtgcaatattagtgtcccatattcaaggaggcttagttcttgaaaggctcattattcagagcagacatttaatcagagggagttgagtgttaaggtcaaactccttgagatgagccactgtgaggagactcttctacttttcaagctaatttcatgtgtgccataaatcttggaaagttaaaaagagggcgggatttgctaggtagtcaatttagcaacattttcttacaactttaagacatttttttctttactattagagaactatttagaacctttaggactctaattatcatgcacacagcttggaagaaattaaccaacaaagttcagaaagcaaaaagtttataagacataatttaatgcactttatatatttaaacagcaacaatgaaatgctatcctcctgtgatgtaaagttctctctttccaccttctaaatataaaaaaacgtggctctcatatacaaatacaaacacacacatgtgcacacgtgaacacacatgcatacacatggacacacatgtacctcacaaactatattaagaagaacaagagaaaaaataatccaatttatgtggtgcttacaatgccagactaaggaggtgcttttacttgccttctaatttattaatcacatagcaaagttgacggtaatgtactaaaattactgtttttttttttgtagaatatagcttagaatcaaagaggttgcatatgcttttcaagccaatgcagctaataaatgacagaatcaatatttgataatgaaggggtggagcaagagagttgaataaaaggctttaccaattgtcccttctgcaggtacaccaaatttaacaactatctacattaaaaaaaaatccaccttctcaagaccaaaaatcagatcagtgttcacagtacctgattttaacttcatatcactgaaagaggcattgaagagactaggaaaagcagtcttgaactgccaatgtcatccctgccccatcccctggcagaagttgtataacatcaaaaactaataatatttgtgcttgggagagggagagtgtagtgattgtgaaactctgcattgacctcagtgttgccctgtcatagtgaaaagcaaaattgggctgaattcgccaatgcctgtgtacagagggagcatttagatcagccataacgagatgaaaattgcccattctagaggtcagaatttgagttctggaaagcctcaccataggaggctaaagtgctctgggtccctaaataaacttgaaaggcagtgtaggccacaagaactgcaactcataggcaagttctagtcctgagctgtgctctaggccagtgggcttgggggactcgtgtcctactgagatgccaactggggcagctaagggagtacttgttccatccctcccccagcctcaggcagcacagctcacagctccaaaaagaccccttccttcaggagaggagagggaagagtaaagagaacttcatcttgcatgttggatgccagcttagtcacagtaggataggacatagggaagagttaataggcctccattccaggccctaactccttaatgacatttctagacacaccctgggccagaagggaaactgctaccttaaagggaaggacccagtactagaaagatccatcacttgatgattgaagagcccttgtgccctgaataaccagcaacaacacccagttagtgtgctatgggccttgggtaagactctgagacatgctggcttcagatgagacatagcatattctcatctgtgatgactatggtgagaaactccttgtccttaagaaaagcagagggaaaagtaaagaggactttatcttgcaccttaggtacaagctcagccacagtggggtaatgcaacaaatgggctcctagggtttccaactccagattttgacttttgtacagcattactggacctggctgggtgagaggggagcccacttccctaaagggtgagttccagggctggcagcattcactacaatctgacggaagagccattaagccttaagtgaacgtcagcgatagcctggcaatactctgcatgggcctgtggtggtggtggccatgggatgagccccctctgcctgtggaaagataaaggaatagtgaaaagagctgtgtctcatggtttcagtgcagctcagttgcagtagaatagaacaccaggtaggtttctaaagttcttaactctagtctctggctgccagatgaaatctctggatctcactcagtgcctgggggaacttgtcagcccaaagggaaagacagaaccctggctggctttgtcacctgctgactatagagccctagggccatgagtgaacattggcaatagcgaggtagtggtaacagtgggctttgggcaagacccagttctgtgctggcctctggtctgacccagcacagtcccactggtggtagccacaggggtgcttctgtcactttatcctcagctccaggcagcccagcagagagaaggagattccatttgtttgggaaaaagtaagagaaccagtgtctctgccaggtaatctagagaatttttccagattttatccaagaccaccaaggtcttgggcaagaaccacagcattactgggcttggagtgctccctaatgcagaaataacttagatcacaacatccaagacttttttttttttttttttttgctatctggaaagccttcccaagaagaacaggtataataaagcccagacattgaagactacaatacctaactcttcagtgatgagacaccaataaacatacataagcataaagaccatctaggaaaacaagaccttaccaaatgaactaaatgaggcatcagcaaccaataatggagaaagacagatatgtgacctttcagatagaggattcaaaatagtgttgacaaaactaaaaaataatcaggttaactcagagaaaaaaattcagaattccatcagatatatttagcaaagagattaaagttaattaagaagaattaagcagaaattctggagctgaaaaattccaattggcatactgaagaatgcatcagaatctcttaccagcagaactaatcaagaaagaaagaaagagagaaatggcgagcctgaatgcaggtaatttaaacatacatacaggagacaaaagaaaaaagaataaaacatgctacaggatctagaaaatagcctcaaattggcaaatctaagagttattggccttatagagaaggtagagaaagagagagaggtagaaaatttattcaaagataatatcagacaatttcccaaacctaaagacgatatcaatatctaagtataagaaggttacagaacaccaagcagacttactccaaagaagactatctcaagtcatttaataatcaaactcccaaaggtcaagggtaaagaaataatcctaaaagcatcaagaaaaaagaaacaaataacatacaatggagcaccaataaatctggcactagacttttcagtttacactttacaggccagaagagtgatgtgacatatttaaagtgctgaaggaaaaaaaactacacaaaacttttatcctagagtagtatatctggtaaaaatattcttcagatgtaaaggagaaataaagactttcccagacaaacaaaagctgagggatttcatcagcactagacatgtcctacaagaaatgctgaagggagtacttcaatcagaaaaaaaaggacattattgagcaataagaaaccatctgaaggtacaaaaaaacacaccaaaacttgacttgtactagtaagtgcaaagaagaacagaatgttataactgttaactatggtgtgtaaactaaattttcttaagtaaaaagactaaaagatgaacgagtcaagaataacaacctttcaagacacagacagtacaataggatataaatcgaagcaagaaaaagttaataagccaagcaacacagttaaagtgtagagtttcaatatttttgtttgtgcttgttagtttgtttatataatcagggttaagttgtcagcttaaaatgattagttatagaataatatttgcaagccttttgttaacttcaaatcaaataacatacaacaaatacacaaaaataaaaaccaataaatgaaatcataccaccagagaaaattatctttactaaaaggaaggcaggaaagaaggaaaaaagaaggagaagaccacaaaacaaccagaaaacaaataacaaaatggcaggaataagcccttacttttcagtaataactttgaatgtaaatggactaaactatccattcaaaagttatagagtccctgaatggattaaaacaaacaaacaacaacaaaaaataagaaaaaacaagactgtatgatctgttgcctacaagaaacacatttcacctgaagacatacatagattacatataaaagaatagcgaaagatattccatgccaatagaagcaaaaaaaaaaaagtggaagtatctatactgatatcagacaaaatagatttcaagataaaaactgtaagaagagataaagaagtgttcattgttagtatatggaaatacaagtagattttgtgtgatgtttttataccctgaaattttgctgagttcatttattcattctaacacatgtatgtgtttgtgtgtgtatgtgtgtgtgcctgtgtatgtgtgtctgtacatgtaattttaggattgactgcgtataagatcatgtcatctctgaacacagggtgaatttttcttccctttttttctatttgaatgcctttatttcattttcttgcctaattttgcaacaaggattcccagtactgtgttgaatagaagtagcaaaaacaggcatccttgtcttgttcttgatcttagaggaaaggctttcagtcattaattatattagctatggatgtttcatatatggcctttattatgtggaaatatatttttctattcctagctttttgaatttttattcatgtaagaacatttaattttgtaaatttttttctgcatctattcagttgttcacatagtattttttcttcattctgttaatgtgtataatattaattgatttgcatatattgaaacatccttgcatccaataaataattccccttgattttgagtgtattttaattttaatatattgttgaaattagtttggtagtattttgttgagaattttacatccatatttatacagcatatgagtctgtagcttttttatgttacagtggttttatttgtttgttttttgaatcaggctgatactggacccagaataagttaggaggtgttcctgcttcaatattttggaggaatttcagaagaattgatgttaactctaaatgattggtagaatttatcagtaaagtcatcttgctcaagatgtttctttattaagaggtattgattactgactaaatctgcttactagctataggtttatttagattttctatttctttataattcagccttggaaggttgattatttattggaaattgcctggttcatctaggttatccaatttgtttgtgtgttaccattcatagcattttcttacaatcctttttatttgtataaaatcagtataatgtttccactttcgtatctgattttagttatattaatctttttcatagtcaatttagataactttattaattttgttgatatttttgaagaatcagttatttgttttgttaactttttaattgtttttctattttgtttacctctgttctaatctttattatttcctttcttctgctaattttacatttagatttgtcttcttcttaaagtgcaaagttaagttgctgatttgatatctttctctttcaattaaagtgtttgtaggtatgatttgttatattagcattactttcactgcaactcggaagttttagtaaattgcgttgtaatttttatgaagatattttctaatttttctgtaattttttttatttattgcatgtctaagggtgtgatgcttaatttcctcattgttgtgaattttccagttttccttttgatattgattttgagtttcactccattgtgattgaaaaatatactttatatgattttaatcttttaaaatttattgacttgtttttttgcctaacatgatctactctggcaaatgttgcatgtgccctaaagaaaaatatgtattccattgttgttgggttgaaaattcagtgtgtgtcttttgggtataattggtctatacttattgttcaatagaaatttcttattgatcttctgttaggttgctatatccgttattgatagtgaggtattgcaatctctatttttgtagtgctatttccctcttcaattctgtcagtgttgttttatatattttggagctctgatatttggtgcatatatgtttataattattatatctccttggtgaattgaccatttatcattatatgatgttttctttaactcttgccacagtttttgacttaaaatctattttttatattattagtgtagtcatcttgcccttttttggttactgtttgcaagtaatatctttttccattctttcaccttcaaattttgtatgtccttccatgtaaagttattctatagttggatcatgttttattatacattttctcaaactatgttttttgatcagagaagttaatctatgtaaaactaaaatgacatttatagggaaggagttactcttccattttgttttttgttttctccttgtcttgaatggtttataagaatccattgtcttcttcttaatcatcttctattgtagttaattaattttttagtggactgttttgattcccttttcatttccttttacaaatattctacagattttattttttgttaccatggagattacttataacattaggaagttataacaatctaaggtgataccaagttaaatttagttacatacaaaaactccccacccttacagccccccctatttgaggttattgatgtcacaaattacatcattagttattatgtactcaattaatatagatttataataatatttattcattagccttaaaaatgctgtaagaaataaaacctgaagttaccaaccaaaatgaaaaaaataaaccttgtttttatatttgcccatatctttatcaaagatttatatgtcatcatacatttttgagttactgcctatcatcttttcattttgacctaatttatttcatttaacatttcacatagggttggtctagtgataattaactctctcagatcttatctgggaatgtctaatttctcccacaaacctgtctgaaggacagttttgttgcatacaagtctttcttgacaattttaatacaagatccctctgccttctgacctgcatgatttctgctgagaaatctgcttattatctcattatggatttcttgtatataatgacacttcatttttattttctttttgtgtgcctgtgtgtgtgtggactttttttttgtctgttgacaaaattctctttgtcttcagatttttaactgtttgattataatttttttaatgtgagtcttcttacatttattctatatgatgtctgttgagcctcttaaatttgtagattcatgtattccatcaaattttgtaagctttccataattatttctttagataatctgtcttctctttctctctcccttcttctgtgattttcataatacagacatgtttgtcccacaagttccttaagttcctctgttcacttttcttcacttgtcccataacacttgatggtgtcccattagttccttaggatctgttcacttttcttcattcctttttttttctgtttgctccttaaatttgattatttcaaatgtcttttcttcaagtttgctgattcttttttatgcctgttcaagtatgctgttggactcctttagtgagtttttcaattgtcattctatttttcagctccagaattttcagtcagttcctttttacaatattatctttgttgatacaatcattttgttcatgtatcatttttctatcttcctttatttatttttctgtgttttcttttagcttttagaacatatgtaaacagttgctttaaaatatttttctagtacacctgatgcctatgtttcttcaggaaatacttgtactagtttttttcatttgaataggccatgatttttattttttctttgtattccttcttcctttttttgaaaattcatcatttgaataaaaagttacttcttctggtcttggcagagtgatattgtgtggaaaatacctcgctaattagtagggcatgcccaaacaattcattttgcctggactatatgtgtgcttttttcaattcctttatatacatggctatttttaaatgtctttatttgacagagagtttcatctcagcctatccatggggatttaggtgatctattatgtgtcttcatctgtattttcttatgccagagtctgcaggtcagtagtccctggctgttttcatgcgcaatgcctgttactgttttccatagcttttcccaggctgagatctgagctatgtcacttttccccatacagccttttctccaaacaagtatatatatagaaaaacttctggtctttatttcttttcttataaggacaacaattctgttgaattagggtccactcttatgactcaattaacttcaattacctccttacatgtcctatttccaaatacagtcacacagggttttagggcttcaacatatgaatttgggtgagggggttccaattcagtccatagcagacaaaacaattgcatgttggtgattaatatttgtttgctttttatttatttatttttattttttgtggttgctggttttactttttcttaatatgtcattattttcctttcattcttgaaaggctattttaccaggcataccattctaagttggcaattattttctcctctccctctgataatatttgttccactctctcctgacccttttggtgctattgataagtttactgtttctctaaataatgcttcttatattcttacttaaaaaaatcaatttgcttttggtgttctgtattttcaccgaaatgtgtcaggataattttttgtctattcatagtatttagagtatgctatgctttctgaatcataagagttctttcctttataatttctggaaaattctcagtgatcattttattagtttggttccattctctctaagttcctatgttctctttctctttatgttctgcatcaggaaacctgagtcaatgcacgttagaccttctgaatttattttccatttatctcatttttacttttactcctctttctctgagttctgcatttcattaactttttcctatatttttagtttactaattctccgttcaactatgtttaatccgttctttaatatatttattgggtttttgatataaagggagatatttttaatgtctgtaaactctgtttgattctttaaaaaataaacatggtcattgtatagctgctttcccttcttatgctttcaattctctgttttgttcctttacccttttcccatatgccccaagaatactttctagcagtacttgcggctgcagcatttaccctgagataactttgccacaaaatatcttgcttttattattaatttttgcaccactctagtatacccactttggaaacaaatgatatcattctatttatagcattctatttttagtagtggttacttgtatttatgaaatatagtaattctccatcgctgaattaataaatccattttcttctaaatatatgattgacgattcagatgattctgatgttagttctgtttagaaataactcaaacaatagctttatattttattttcacattaaaaatcagatttgcttcagcctcaaagagtgtgtttatataaaattaaatgagcattgacagtgagctgcctttttttttctaaataagaaaagggttaaacacataaagtgtattttctgtgtgtgctattttcaatacctgaagtctttggaagtctaattctgttgttttttaatttctgctgactctccctaataatggcttattttcatgcaaattttgaaagattggggaaaacccaattaatgtgaagctctgtttaaaaaatgtgaaggactgaggttatggattttttgaggagaatattttttcctctctaccactttgggtgctgtaatttactctctcatatctgttctaacttacctcccaccttggagatgcctgatgccttctctcctgtactgttaaatctcaatactctggatcaccgtgaatcattggttctcagtgcatctgctagctccagagtgtactgttcaaccttcaggcttctgctagtgaactgaattctttatttaaaaaatcatattttatctttttttttttttttttttttttgagaaggggtcttgctctgtcacccaggctggagtgtagtggtgtgctctcggctcactgcaacctctgcctcctgggttaaagcaattcccctgcctcagcctcccgagtagctgggattacaggcgtgcgccaaccatgcctggctaatttttttgtatttttagtagcggcagggttttaccgtgttagccaggatggtgtcgatctcctgaccttgtgatccacccgcattggcctcccaaagtgctgggattacaggcgtgaaccaccgcgcccggccatcacatattatcttgtattttgtagttttagctacttttttttttcttttttcaagcttcctgtttctttatgagaaaggaaatggtaaataatcacttaattttgaagctctttatgtgagtacgtgactgtgtgggaaaataaaagagacattaagccaagtgaattcaggaaaagcttccaaaccaatagaagggaaaatatatgggagaaaaatatatatttttttcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcctggcctatatttttcaatccaacagataacagaaaagaaataaaaagaagaagtctggcaactaggaaaaaaaatgatatggtttcatcaaacctactatatcagtactctaattcagaaggtttaaagtaatctattaaacgatttttcaaaaatggattacatatttttgaaatccaactttattctccttataagacatgagtattgaccctatgttttacaatatctaaaactgtatagtaagtaccgttctctaccttagcatatatcaactctcattgaaactttaccatgtcaccattatgcatagtctctttatgtgtaaacttttttagtctagaaaaattatttttaaaaatagattatctctatcttctttcttaccaacccatcctctgggttaaatttgcttctttctaattttttttcatactcatacttttagttataaagtctgtaagttcaacttagtggtttatatctaaagtttttattttggctttacaattgcatgattgtttgccttgatgtataattccagattgacaattatcttccctaagcactttcattctattattccatttttgtctggcatttattattggtgatgaaacatctgcttgtcttgataataagacattctaattgccatttgctagtaagtaacctgtttttttgctttagaacgttacattttttatgttcttcagttttattactatatgtttactgtagatttatttggatttatcctttttaatatttaatatcttttcaatctgaaaaccatggttcttataaattatagaaagttcgcatcaaaaaccttttcgaatgttttttttttttttttttattctcttctttatctactttgggaattcttatgaagtgaataccaaagcctcttaatctatctttcatgttttaaaatttctttcacattttcctcatccttttagctttctgtatagtggtcagcagtgtattctaaaactgtattaatatactgtagatgttacatttttgaagacttttgtttcaatggtcatgtttccctactccagatttttattggaatggctctctttctatattctggttacttctcatgcagcaaaaagctatcttttcttaccaccttttctgataaatatgttttacttatctctcatttcttttttattttttgcttcatttcttctcataactcatattacttcctgaaatgtttgttcttaatttctttctttccccactccttctccctctctttttcttcccttcactcttgattttctccctcactacaagtcagtagtgacttctgtgttttgttcatgtttctttctagcacctataatagcgcctgctacatagtaatgttcaataaatacttgacgaatggatgattctctttaattttccttctcttgatacaaatctatttttgtttttaaattcgtttggttaaaatattgttaatttctttaacttttgagagtctttaaacatgcagttattcctttctgattcttttggtagttaaattaattttttgactgtttacattagtttgctcttttacttagcctactttaatctaggggatttgggatttcagcctgcatgttccctttgaggaccgtaattcttttctcccatgttccctttgtgttctgctccctttgtgcgtattggtttaatgattgcatctacccagacacattccaaaatcaggtttccaagtggcacagaatggacagaatagcttttgtcctcagtgctatcagagcttactcactgatcctgggggtgctttggcaaggtcctgattatcaggctgtctctggtcactcccaccatcctagtcgtataggctgacataaagcaaaaccctgacagtggtcactattttcttgaccacttttacataggtgagaaatctattctagcccctctttaggcctggttgtattctcctattctcctttattcatgggaagactttttttcttttttcttttctttctttctttttttttctttttttcttttgcctccgttgtactaagataaactcccagttacctctacctattttgggacctggaatgcagaattgtcagtttgtgtcttcagcacacttactgatttgcattttaaaagtagctaagtcttacaattcaaaaaaaatgattatcaaagtcgtgcttagaacagaagggttgggaggaaatttaatgcaagaacttgactaagtttttaaaatgttaaatataatacaaatatagaagagtgcataaaataagtacacaaattagcaagttgttataatgtaaacaccatgttaaaaataatccaaatcaagagatttaccagcacccaaagttcctctcatgctccttctgtttttataactacggtttgtctctattgctgtgtaatagtccattctaccagagatcagcaaaccatggcctgggagtcaagttcagctcaccacatgtttttgaaaacaaagtcttgttaggacacagacataattttttatttaaaaattatttatagcttttttttttttttgctaaaatgaccaagttgagtacttgtgacagaaaacatacggctcagaaagccaaaagtatttattatctagtcctttcagaaaaaaaattgtcactctcctctttatatgattatatggtaatattttatccattctaatgttgttaaagatgcagattattattaacttctgatagttcattaaatgctactaaaataattcatcttcacttctcttggatcacatatctgtgtctctgtagcggtatatttaggaaaggaatgactgggtttttggtacacttaccatcaatattatgagacaacgcaaacagttttccaaagtcatcatatcatatatacatatatatatgtattgcatttccactatgagtgtgttagagtgaactttattctacatccttggtaacacttgatattattgaatcttttaattttagccattttgatgagtgtgtagttttaatttcattttccggttggctaatgagattggttatttttttatatgtttattggccatttagacattctgttttgtaagtccatattcaaattgtgtgtttgcttttcatctaggttccccttttacttctaaattttgagagtacaaattacctgatagtgtgtcaaatttttccccactgctatataacgtcatatttgtaaacaaacaaacaaacacctcaacaaatacaaattcatgggtccatttctagggctctgtagcttgtttcaatagtattctgtcctaagtcctgatacccagagaagcaagtcctcctgatttgttcttcaaaaatatcttggatgttcttgaacctttatctttccatattaattttacaattagcttttcagtttacacatgcatacacacacatgcacacaccctgttatgatttttaatgtggattaactttataggtcaatttgaaagttttcaaaaaatatttttgctttggcttccaggaaactctgaaaaagattttgattaatctgcatatttgttggaactttctatgtccttgaccttttattccactgtttcatgtttcctaagaattgcctgaaattatgtgtggagggaagcaaggcatattaacaatttacaattggagcaggagcaggaggatgtggtgtaactcagtaccatcaatgtctatctgattaggactatagtcttaaaacctgtgttactttaaaaatacagatataatttttagatccaaagcatgaagatattaatgctggcaggcctgaaatttgactgacttatcaatatttttaaaaatcttagcaggtgtttctaatagataagtctaggttgagcattgctgggttaggatgttgtatagagagcagggcctcttgaaatgctgatagcagcatcctctctggccttgaacaatacatcaagacttgtgtttggagtcaaagttacttaattttcaaataaatgaattatgagtatatacgcctaaatctttgtgtactatcataaaattctgccaccctatgaagatggattgatgtgaacatggcagttgggacttgtctcctcttatttttatttttttgtgcatgaatatagtcctaacaaataaatcccatccttggtgaacaatttaatggttatgtttctgttctcactgaacaaacacagaagaaatatgccagactaaattaatgaagtgaaaacgatatattcagtaatcccatacattttctaatatagactaaaaacctattttcttccatcttatcttcagacataatggtatgaggaaaaaaacaattcaaagaggaagtctttaaggcaatttctacatgaagtaacatttgttgggttcatgtgtcacataacaggcattccaccttttacaattcaatccctttaagcggcttatgaattaggcagctatttctattgaaaaaatgaagataataaaatcagaaaacttaaataaataaaaagttacattcagtgaatgaataggagtagagtctggatttgaatcttgcttttggcttttgtgtgtgaccacatgtcacattctttccaccacccacagagacaaagcgacattcacattgaaggtgtaagagatggcaatgaatccatgacctcagagaatcacttcactgctgcatgaaatggataataattatttcttctcctttcgctggatgttgtggcttaattcacatttgtaagatgttatggataaaatcactgcaatcgctaacaggcatttatgtcccacagtctctttgggcttcttgccttttatcttccagcatgccatagcgatggtgctcgctggatttatgaacaccgtgactgtctgtttggaacactgagatgtgaaattgcctccacattgaacaagatttggctcttggtggtaggagggttgtgaataaagtgagcactggtggtacagaggaggacatgctgcaacattattttcagtaataatcctttagttaccaggaatgatcattttttctgattcattgtttagtttgaaaacaattaacaactaaaaatatcatacatttaaagataatatttaagtaaaatatttgcatgtagaataaaggtttttacttaccaaataaaaatactacaccttgaagtttgcattctgctttactgttttacattttagacagaaattaacatttgaagtggtcacaaagaatgatagaatgaaagtcactcatattctgtttgttcttctttacagttaagacattatctggtttattttgactgctgtttagacatgagaataatgtggtcctacaggctctgaagacatgaactataatgcactgtcctctaagtgagctcaaatgattctaactccttaccaactgaccctccaaacaaacacctgtagctgagtctgtatttgtcaggggccaacagtatgactgggagttcttaaagtaatttgcatgtggaacataatgtttattataggataggtcataaaaatgtgctcatttgacacagagaaatgtaatatcagatctcaatagcagttaaaacactccctagaagctagaccaaaaaaagattttttgaggagaaatatttttctttgacattgtttataattggtgaagcacagcaatgacaagtagctgaatttcagttcagtgtttccttttttaattatctacagacaatgaacatccttgctgtctgcatgtgggatggatcacttcaccctgtagcctaacagcactttttctgtgactgttatcacaatccaagagaccttggagaaaagctgctttcttacataaaacactttcaaagaaactgagcaaagatgctaagtgtgcatggcacatggcaagggtgagcacaaatggattcaggcttccttggaaaatcaagaggatagagtgtgttgaccaaaatatctgtgaatggatatagggctagaggagtctggtggggtcatgtgttgcaaaagaaggggaggtgcccattctgaaatgaaaaaagttaagtgaaaagtctacttatatgtgattcagggacagagggaataactgaaaaccctccctctccacggaggctctgggctaagtcagctgagtgttgtgagtcatgaaagccgagatttggagagtccagtgtaagaaagcacagggcatgaatgccacaagcacattcagtgggggaagccaggtagacactgaagtcagggcattcagggggatgccagcagagagacgtggattaggaaaatgatcataagataaagtcttaagcagagcttgaattcaagctctgccatttattagctatatccttttggccagtttacttaacctctctgaccattaacatcttcagttgcaaaatggagtaatgacatctagtgtttctgggattgttgcaaatataaaagaataatatatgcaaacctcttgccatgttgaaggtatctaggaaatgttccctatctagctgtggcagtaataaaaataagcatgcaaagccacagccagacctacaggaggagcccagagctatgatggcagacttgggagaagctggaagccaatagagaggggcccctgaatgactcttgttgttgaaaacctaggaccaaagtcaggagaatagatttcagctctttccttgccactggctggctgtgtgacagatggtttgctagttgtctttcctgggcctcctttagtttcttctagagcaaggttattgttattgggtcactttgtaccagtcattttatcaccaggaatattttggtcccgataatatgaatgataattgtccccatgtttaagctatgatgttaaaaacatgctacctctttttggtctgtttgcctacctccatgcccaatccttaccacacctgaccctatgctgtcctcactcccactgcaccccagagccttgcttacccttccacccaggtaaggtgcaaagattccatggaactgtgtttcgggcccagtagttagtaacaagggaaagaaaatgtatcaaagattcattccctagatggttgtgttgttgaggtgggagaatcggacttcctctgggtagatagccgtcagggataaagaaagctcagggacatgtttaggatgctcactgcaaaaattatctaataataaaaaaattcacacataaaaataatggtttttagagtcccaaaatggtggagtttttatttccctggttttctttaaaaaggcacatttttattttctatctgtccatttagtcattcatgtatttaacaaatatttatttagttcttcttatgcccttggtgctgttttaggtgttggggataaaacaagaaatcaacagtggatacaacaataaacaaagagataactacctatagcatatcacaggtattccaaaagcaataaacaaaccaggataaatagttattgacgtgatggtaaagctgcgtatctccaaatttcagtggctcatagcagcaaacattgttttctcttgcacagtggcttgtgcttggctggagtgagtgacctcaggctgctttcacactgagttctgctccactgtgcttatcctccttatattagcagccaccggtgctgctagtaaatgttctcttcttgtagcatgataggaacacaagggggtgaagggaaagtcatatggcttcttaggcttcaacaagaaattgcaaaattctatctgaggcccacagtctagtagacaattcatgccacgtggataagcccaagatcaattgggatgtgaggggtacagtcagttcatagtgggtggtactgcaatgtcatatggcaaaggcataaatgcgttattctattaagggaaggagtaaagaactgaagacaacagtgcaatctaccacacagggaaaggatgatgaggaatgtcagggtaagggggggtggcattttgtatacagtggtcagagaaagccttcaccatagatgacatatgaccagagaccttgaggaggtgagctgggtaagtaattggaaggagagtattacaacagagaaaagagctagtgcaggggtttgcttgagaggtcaatggggccgaagcagtatctgagctggaaagatggaggaggtaaagtccaaggtatattaggggaggagcatgtgtgatagggggctgaagcaggtaatataagcccttataaaggtttcagtctttactctgaataaggtgagaagatattgggggactttgatcagaagaaagatgtgaattgataagtggtaacaatataactgatggatgtattgagagtgcatgcagagagaccaaggtggaaggaagcagtacacttacaagtttattgcattgatccctatatggactgatgatagcttggtctacggtggtgagaaatgataaggctctggatatattttggaggtggtgatgataagatttcaaggtgtatcagatgtaggatatgagagacagaaaggagtcaaaggtgatttccaaatgtttggtttgagactggaaaggtgcattgccaaaaaataaggtcaggaatattgtcagccacgatatttagaaaatctgattctcattggtgaggataggaatctttcttcccctgctctgcaatgctgagaagtctttatgaaaacaacgcaagtaccacaataaaatactattcaggtttttatatgttccacttaaaccaaaccactgtatcatataagctagaattatgtccacattaatttttgttgtactttgattttaaaagtcatgggaaatggatcctagaaataaataattcatggaaactacattattaagttaattctaaccaatagcatgtcattaagatacaaatgtgaaaatagttcaattttattttttaattaactcttcagaagtaatagccgacaattgtccttgatcaggtcaaatgctgtttttaaatgcctgacagtttttaagtctttaatggaaatcaatggcccaacttcctgaaatgtattaattacatttatctttctaggcagtttttagtaaggaccaggacttaaaaataacttccaaacattctctggctaaagtctatttttttcttaataaattcacagtgggcatttactattctggtatcttccccacaatatccaaactttgttcactaattccttttccttttctctctacatccatataccactttatctttcaagcatcagcgtaaatcccatttcctacattcagtgaccctgcctccaactcacactgatctcatatacttcaatgtgatattttatatggaagtcattgttttttgcataagattgcaaagtgatttggaaaaaaaaaccaaaaaccttggtaagcaaccattcaacaaatactgcatttttgtttttcatttctcattttgtatccctttttatactgattctcggcaggagtatccaagagtggaaacatgcaaggtttcagaatcttttgcaacttaattaggctctccgtggaatattctgaatccctggaccattggagcagctgaacctggagtttggaggaaagatgggactgggaggcagcgagtggggatgaaggagcagcctgtgtccccttcatttgatgtggtcctggcatgctatataaaaggagtggggattgaggcgtcagctgttttgctggtgtccatggcatcatttactggatgaaacttgcaggacgctgaggtttggacagggaatggctgagccaaaactgaatcttccttgctaatcgctgtgcacagagaggataaatacaaatggatgcaccccaagaggcagtcactgtcattgaacaaagggaaattagttaattattgctatagtccatgaaggagggatctgtctgtcctctttccaatcctctcctcacaacagtggtagtagtaggaggaggtgagatgtggaaaagcagaccccacctcccctccatgccaggctgcatgagctgcaaggctagtcatatctggaagttttaaattgaaaataaaattaaagttagtaagtgaacaacagtgagccagcactttgggaggccgaggcgggtggatcacgaggtcaagagatcaagaccattctggccaacttggtgaaaccccatctctactaaaaaaaacaaaaattaccctggtgttgtggcgggcacctgtaatcccagctactcaggaggctgaggcaggagaatcgctggaacccaggaggcggaggttacagtgagccgagattgtgccactgcactccagcctggcgatagagccagaatccgtccccccgacaaacaaataaaataaaataaaataaaataaaaaagaagcaataactcttccagtaatcaaaaaagtcttaattttatgaactcaggatgagattgtgttaagggaacccaccacccagtgagaaatgatttgaccaaaggcagatagtggtatctgtcaggacaaataaaagcatctcatgcttatagcccaataagttaaattttctcattaaattggtgattttctgaagctagtttccttctttagaaaaaaaagcaataataacaatctgttattattactatgatccactggctggtaatcatgagccggacgtgctgactctctatacctagcagtctcaagggcacctgtgagcggtaaaatggctttcatccatctcacaacacttgaactgtgcacatgtttagcgaacaaatgtttacttctcacactttgtttttatctgtagtattcctgtaagctgtgaacaggaattcctgtaggtgtgaacactccaaggtgccatacacttagtttgacatcaaaggaaaactactcttatctttccccttgtggtctttgttctgcactgtttgtctcaacaccacatacttccctcttataccgccaatgctcccaactttctcaatcattattcatccttaaatttcaggccttggtgttcctttccgcttgacacagatttcctgcataaaaccttggcttctcttcaatcaccatacaggttttctggtagtcttacactgctgtaggtaaatattattcagttctatccaacaaagtacacccaccagttctgttcaggtttgttagaagtcaattggttatgagtgatttttctatacagtcatatgtaccaaattctctcttatgcattgctgagaagtattatagtctcaatactcacactgaaaaagttgcttgctacttctcatctgcctgtgattacatgaaaaagctttgcatgtaggtcagaaacagggaaacataaggagccaacactcatttctaacattaatggaatggagaataaggacattcagtttagttgtaaataaattaaaagaaaataatttaaaaagctattgtcttcagcatttaaagttttctcaacacttgctcagcaatgctattatttctcagattctgaaatggctaccctcttatcattttaatgtaagtgactttctgtatttctttctctctttttaagtagttattcttcaggaatgaacatcaggatgcaaagaacaattcaccacctaatcagtcatttatggcagaaactgaatcaaaatgattagacttagtgactctgagtgtatactttgattattgctttttcaatttgacctactgaagagaacattattttatgcctgaatttactttgctctacttttttagttaaagtcttataaattaaaaaaggcatttaatagaaataaaatatagttatattggcatgagggagattttccatataaatcgatggaaagaaattgaatcaacacttacaaacaacattgttttggttatttaggattacgtttacccactgggctagcaagtagatgacattttgcctcatatttgatattcgactaattcttttttcagtgtggaatgaggcaggtaaaatgtgcttaagatgttctaagaagtcacaaggtaggtaaaaaattgtgatctttgaaattggccaaatctgtatttgggttcacatttcatcactcaattgttgagtgtctttcttgaccatcttgttggaccactctgagtttcactcttgctgttgaactgaggctaataaacccttctcctcaatagacattgtctacaaggtgagcagtcaaaggcatttatatgctatgcaatgatttgaagcacactttcaaatatatggttcaaaacaaactcacgatgtatatattatattttgtcatcactcttttgagctgatttgatgagaggcattttaatgtagccaaaataaacaagccattgaacattaaccttgatggacgatgcaactcaaactaaaagttccttgagaagtaactgatctgctcaaggtcacacactaatcaggacagaggcaaggcctgactcttggtctcatgagctaatatttatttatgttgaccatgcaagctatatccaaaaatagtacagaattttagagaattttaaactctgtcatagatggatgtttgattaatcgagcggactgtttttgtttaatggaaacaattaaaattatctttctaaaataatatattgaaactgactcacaatactaagttatatgagtagaatgacatctgttatagccacattctatttattatctttaatatattattttaatatacttgacattttatttactctttaagtaataaatatcaaataagagcaataaataaagctgatttataaattactgttcttctatatgagttaagatgcagtagaatataccctcttgagattactagactgggttttagtataaaacatgagtgcaatttgcccacatagataggttatgggaagatagttttgaaactcaggaagagtcactctgaagaattgagactggagttctgccaagagatgtgcaagtcaaatggaattctgcaactccagagagggagagagagagtagaggcttggaaggaggaagagacaaagttttcagttctcactaggcacagttgaaatttctactctgtgttttcttgaaatttaagtgactctttccaatcgactcttatgtaagtcagtctgaatcacttttggtctttgcaaccaaaggatgtattaaaaccatcttttgcttgtcagttaaacatatggctgttgtttaaatgtaagaatggagagaaaaggtgccacgtaattcaggagtctcttcatctttgtcacagagccttgaactatcttcccaataaatatttgatttgaatcttcagcactgaggggaagtgtcttctgaaataatacaggctaaattgttatgtagcagccatctatacaaagcaaatttttgtaatatacaaaagaggggattttgctattatatcagttggcaagaatcattatcgtgattggaaataaatagatacagagagaaaagaatgagatttaaaaaaaaaattcagcttcaaggaaattggattttctgttgagtatggaatcgagactttggaaactaaaaggctagaaaaagattgctttattaagaaaagtaaaaatacatttttttcatttgaaaaatgcctactagacaataaaacatctggctaaaaaatgaaatcttcagtgacacatctggatatttgctccataagatatcaaacatgaggataattgaaaatatagagctaaattacttaaatgttaagctcccatccagatgtttgatgctatgttagatgaaaaaactctttacatgccagacattaaagcaatcagggatatctaaatgccaccataaataaaatagcattgcaaatatggttcactggaaagaatgtattaactgataattacagactacacaagaaatttgcttcttagttaaaagtttttttaatttttttattttattttatttttttccttctgatcagtagtaactaataaaacatggaaacacgaaatagacatccgtagacgacaactggtcaggcttattgacaaacaagtggatttcatttccaaactatttttttactatatatagaaatatcaatgagttagaggttttggctcctaattagagaatataaaacttgatttttggaaatgcattggagaaataggacaaaattttgaatttcaattctttggcaatatttataaggaataaaatccaaaatagatgaaactgatataatttagcttcaagaagtaccagatgacaactgaagttggctcacaaattataatctatgggagaatgggaagcagtgagagttaaacagtcaaggacagcatcagtcgtttggctgacactgcagatttatacagacacagttttaaatccaggcagatctgttagtgcagagaagaaagcactgtatctcttatgtggttcaggcaggaagcaagggttataatctagggagtcagaaaagttaaagagtgccaccaagttatgtgagtggacagagttgaatgttgcctcaaggacaaaaaaacaatatcttctctgttctactttttaaaatggacttttaacatttaggccacattaaaatttttgcaatcaagacagattcatcaggatgttggtaacaaattctaatacatctattgtaagtgtctactcaaaatgaagataaatattttaaattccatttatgtaagaggaaaacaggggctcagagaattaccatgacacatccaagagtaacactctgtcatgaggaagcagagtatgactacaaatccaggcctggctaattcaaaagaccacactttttcacttgtcatgctgactcttaaaacatcaaaacctgatcagttgctttggtctgaactaaggtaaaaattgctacagatgaactgtttcctagattattgctacacataactctttcctagattaatgcagatgtgtagatgacacaaagtgacttgagcaacaaatctgattactgaaaagatttaacatattgtacagactactgtgtgcctgaacaacagaaagtgctgaataacaaaaaaaaattgtaggtttaaaacatttaaaacaatcaaattctttaaaacatgcatgtaactccgtgatactgactcagtgtttggcacacagaaccctgtgaatataaaatgaatgcccgcctgaggaaactaattttatatctatatctacatctttatctatagatacatgtatatatatttttatcaatatcaatatttttcttgatgtcaaggtcaggatcgtggctggtgtgtcagggtccacaaatgtcatctcattcaggaaagtatttcaggcttaggtcaaattgtcagaagcatttgaaccaaagcaactccatcttaaagaggagcttggtaaaatgagactgaaacctaccgggctgcatacccagatggttaaggcattctaagtcacaggatgagacaggaggtcagcacaaaatacaggtcataaatacctggctgataaaacaggctgcagtaaaggaaccagccaaaacccaccaaaactgaaatggggatgagactcttctccgatcgtcctcactgctacactttcaccagcgccatgacagtttacaaatgcaatggcagtgtcaggaagttaccctatatggtctaaaatggggaagcatgaataatccaccccttgtttagcatatcatcaagaaatagccataaaaatgggcaatcagcagcccccagggctgctctgtctatggagtagccattcttttattcctttacttccttaataaacttgctttcacgttgcaccgcaggctcgccctgaattctttcctgcctgagatccaagaaccctctctgggggtctggatcaggaccactttcctgtaacaaaatcaagcatctttccagacaaagcgtggttttacccattctagaatccccttcttaatttataaggccgagacaagtgtccaggtaggccttagctgcctggtgaatagtagagaaacagttggaattatatctgcttggttaaaatccaagaaagcataagccaggagtcaattggaacctctcagctcttaaaagtaatattggaatattttgttccagtatttatctatttcactttgcactgcaggctctccctgaagtctttcttgcctgagatctaagacccctctctgggggtctggatcaggacccctttcctgtaacaaaatcaagcatctttccagacaaagcatggttttacccattctagaatctccttcttaatttataaggctaagagaagtgtacagaaataaacttctttgatagtttttagctgcaacagaagtgtgggatggggcagtggagtgaagagggaattgtgttttagtggtgaactttggatcagaatctggcttctgccgatttgtttaattgcttaactgatttttttcttttttttttttttgagacggagtctgggtctgtcgcccaggctggagtgcagtggcgcgatcttggctcactgaaaactccgcctcctgggttcatgccattctcctgcctcagcctcctgagtagctgggactacaggtgcccgccaccacgcctggctaacttttttgtatttttagtagagacggtgtttcaccgtgttagccaggatggtctcgatctcctgacctcgtgatccgcccgccttggtctcccaaagtgctgggattacaggcgtgagccactgcacctggccagttgattttttttatccttttgtgatgcctgaattttgggcttgaaaacccagatgtcaaatacacccttttctttaatatttgcagaaagtcctcattcatagacatttgtagtttgccgcttttatgagagatacagtaagaggagggggtggaagagggggtactcacatctaaggtaaccatcccactggcccacttttggccacccattgtgagaacttttcccatgccatctcatccctagccttgaacctgctcccgctccactttctcccttttcccttcaccagtcctcctcttttttctatatcttcctctcattttcatatgcagtaccacttattcatcttttgtttgctgctggctgttgttttgaaggttttaagttctattgcaaggtgcttatgaaatagtttcttaaattaaaaaaaaacttctaaagtaactttatggtgcaactattattttatcttattttataaaaatgatatttttggggactaggcacagtggcttacgcctgtaatcccaacactttgggaggccaaggtcgttggatcacttgaggccaggacttccagaccagcctacgcaacatggcaaaaccccgtccctactaaacatacaaaaatcagctgggcctcgtggcacacgcctgtaatcccagctacttgggaggctgaggcaggagaattacttgaacccataaggcaaatgttgcaatgagctgagattgtgccagtgcattccaccctgagcaacagagcgagactctgtctcaaaaaacaacaacaacaacaacaacagatctttttggtattcaatcaggtatttttaaaccatatttaatacatctaactagtaacttttagattttatctcattaatttaagtgttttgatgtctgaatatttaacatctggacaaaatggcttcagtaaaggcaggtgtatacagtattttgtgtaattccattataattctattttttccagtgcaaattcttcaatgttctcatcaaaaaagttatctatggaaaggaacacggcttcctttgcattctcatttgaagcaggaagtgtgaaagaccgcgctagactcagtaattggctgtcatacactatttagaacgctgctttgaagaagacctgcttcctcctttactcttctctgtttgcaccacaaaatattcaaatggaaagatcaaagtggaatgttcatttttattgcctctatttcatgtgtgatacttattctaatccttcttggagtaagggtcaaagattgggggatttgaaacataaaacagaatttgaagggggatggattgagtctggtagctgaccaggagactgacttaaattagaagaagctgaactgtagtattcaaaatacaggtaaaacttgtaatgttgtctttatatacatgaaagcaggaattcatcatgtgagataataaaatgcaaggtctggaaggaaaaaaaaaacatgagagaaagatatcctcatgaatttgtttactgactgcttggtgaagttatggattacatgcctgcagtccaaaatggaattctgcctctgagagcttgcctttgcctgacttctaaacacaattgcctggaagaagatggtgatgcgtctgtaaggagactggttttacaggaagtgttacttcccgtcacactaattctcctggagctaacatttcaaacacttgcacttataggttatttctctttgtagaacagaaatgagccttcattttggctaccagtactttagaatacttggtgaaaagtttctttctctccctctctctctgtctctctttctcttctccacccttgcccatcttctctcttaatacattttattttattttattttattttagaatcttacctggattctccttaaaaatggtgcaacataaatatatactcaattttgtttttctttgctgcataaaacagttttttttaattaaagagaaatagctataagtggtctaccatcaacaaaaacacaacaaacagctcctttgtaccactgtcatgttgccttccatcttacagtcctcagtttcttactgctcacccccagtggccatagatgaaactaaaatctctggatttccctggtttgtgactctcaactggctcagctagcagggattgggcactgggataaagcctcccattttctgctttctttgctattcttctctgagttggtctctcagctgtctggtaggagtcagcatgggcacattgggtaggtctcaggaaggcatatctcacaagaagtctcaggacacttctctaatgaggcatccggcagagttatgaatggagccagaaacgactgactgggctggagaggggcacctggcgattggcagagcagtcaaaggttgtcaaaatgcacaggctggaatcagattgcacttgatatcttaggaccgaatgtttcatgagttgagatactgtgaagaaaaataggtggagaatatttctgagcaattggttggtttacaggattatttcccacgtcttttttataacccctctttccacctgaaaaactcctagttaaccttcaagattctgccttgcctgatacaagaattaacttggttgctccattcaggtcccttcaaggaaacgtcatattgcataagtgccccaattgatccttttaatcatgacctggtcacctaggtgtccacatcttcccttgacctcagtcttttccctgtgtttccagtgcaatcacagttcctgatatgaggattcttaataaatagctgctgcatgaatgaaaaacaagacatagagaggaagcacttattagattccagactccctgctatgcattggggattcaacaacaaatgtcacaaacttgttccaaaatattatttgtacagtgaggcctgtttattgcctggtatgggtactgttggcagatacggggcttctgggtgtttaggaaaggtcaggtaccttcttcctgagagttttagaaagactgtgtggtctattttttaataggaagccttaagagtggagtccagcggcacatgggaaaatataacattgaaactattggaaagcatggcatcaatgtggaaaaacggggtcctacattgcaatttaagttgttgtagatgaaaacagtaaactctgaagagtggggccaacattaacctgctggtaggggttcctctcaaggtcaggtagccctgagatttatgctaaaggacaaggccagtgcttaccacatttagcaacttctctctcggtgagtcctagtttagcacgatattgccacactcaacgactcgaccccacgatttcaaatggcaaccccgttgaagtggatatggagttttgcttctgtatgtccattgaaggtcatgtatgaagatgttaccaatgttaagctattctgaatatccccagtatctcttcaagtgcaaaacttacagcattataaaataaggggaagatatacctgaaaaaacatgaagatttggtaatttaaaaaaaagttttaaaaacaaaaattgcttaattaaagtcctatatgaatttaggcaaaatacacaaactagctgatctccagattccccatatagatgacaggcaaagaatgtctacaattattgataagattaaatgagataatgtgtatatttcttgcacattgcataaaacttcaataaacatttgcctacctaaatttccattttctttcattatatacctctgtataaggcccagtcagaatgcctttccagatataaagcatggcaataactaggaaatttggaatactggtaaaaatttcttgtatttttctttctttctctttatggggttccatcaaattttgctggaccatgtcacttggatatttttagatgagaccttaaaaaagtcatatatgggccgggtgtggtggttcatgcctgtaattccagcgctttgggaggccgaggtgggtggatcacctgaggtcaggagttcgagaccagcctgggcaacatggtgaaacaccatctctactaaaaatatgaaaattagccaggtgtggtggcgggtgcctgtaatcccagctacttgggaggctgaggcaggagaattgcttgaacccgggaggtggaggttgcagtgaactgagatcacaccgttgcacaccagcctgggtgacaagagtgaaactccatcacaaaaaaaacaaaaaaacaaaaaaaaaccaaaaaagtcatatatgttacgccaaatatggctgataaaactgaagaggttgaacatgtaagtagtagttgtgctcagacattagagtgcctgtgaagaactacaaagcttgctatcgttttatacatttgttatggtctgaagaattgtatttcctcaagattcacatgttgaaacctaacccccaaggtcacggtattaccaggcgaggcttttggctgattaggtcaagagggctctgcccttaaaaatgaaattagtgcccttgtgaaaaacgcttgagggagcttgttcaccccttttgccatgtgaaaatgcagcaaaatgtgttatctacaaggaatgggcccttgccgcatgttgaatctgttggcatcttgatcttggactttccagccttcaggactgtgaacaatgaattctgttgcttataaattactctgcttataaattactctgcttataaattctgttgcttataaatttgttacagctgcctgaatagatgaaggcaccattcgagtctctggattttactttcccaaaattcagtgagttccagtatcattctttgagaaatccaataattgtttttaaccttaagattaacaggtaggaaagtgacacacacctgaaacctgttactctagtggtagaatctcatggtttgcaaacgtactgctgaaaatatttcctgcatatgaaaggtactctgaagcccctcagaagacaccacaccacccagactgctactagataacatagactccaagaatggcatttgctaatgtgtgtataaaatggcattttagaattgcctaaatatccttattaacactttctaaagaattgctgttaactcttttaaaatcaattagattgccgaaggaagagggaggggataggtttaagtgaggtactacatcacatagtgttggatacattttccaaaaagataaatgtaagtctttttgaacacataatttttgtggccatattgtctctgaataaaaggacaattgggttgtcttcaatctggagagttctagttgttttcattttttttgcctttattctccccagtttcttcatgatgatgcatttgtttatagcctgcacaccacatctgatacatttttaatctttagtgagccatgacaaactcagaaatgattagaaattccaaaagaacatgttttttaacttcactgagtactttttttttttatttcactctttgttttctttggaaaacaaataaaatgtctgcttcctcttagccatatctctctaaagtgttctgttgtgtgtcattagccaacaggcagctgggtaaatgctggcccacatccaaaatgatgattgcttttcataagcactgtctttgctgttggctttctgactaatggcttctgcttgtaatggatacaatgtagtatgattaactctcaggtgattaatagatggtgtttctgagaactaaataatgaagaagcaattaaacaaatctgatatgctgtctttaccacaaatcaaataacactttttcttcctattccttggacagtggtttggaggtcataaagctgttctgactcacaaatgggagactttggcaattgttttaggataaataaagacaggaaacatagtacaccctcttcaccatcatactcacctgtgtttgagattttgtagtgtgtgatatgaaaaataggtgtcatttaatccgtgagccccaatttcttcatctctaaaacagtgattataatagataatttgtacctttaaatgaagattaatgaagattaaacaacacaatgtacacaaagcatcccacaaaaatgccaaatacatagtattcagttaatatatgttggtttcaaatacctccctttcttctagccttagcactcatttttctggaagcaaagaatattaggagataggatgaggattgtcagaaactttcttttcttctctgaccttcagtaattcagaaaagaaaaagattcatccctctactaacatgaaaataattgccatttgcagccgtgataatcattttaagttattagtattaaaaaaggcatatcatagattatcgtatttctagcctccaatatcaatttctatactccctgttacttggccttggctgtgtagaattttaccatctcactagaaataataaacagcaaacatcaaaacaagcaaaaacaagtaagcaaacaaattataggtaattaatatattttatactttaaacatttgaagatggtgagtttttttttttatttttattttttgagaccgagtcttgctctgtcgcccaggctggagtgcagcggctcgatcttggctcactgcaagctccgcctcccgggttcacgccattctcctgcctcagcctccctagtagctggaactacaggtgcccgccaccacgcccggctaattttttgtattttttagtagagacggggtttcaccgtgttagccaggatggtctcgatttcctgacctcatgatccgcccgccttggcctcgagatttatttttaaacggcagaaataggtggctaatttgtcttggaacaagtaacaccttttgcttggttatgtctcatgaacaaacaatcccacaatctcagtggcttatagcaacaagggctaacttcttgctcacgtcataccatagctgaaatcatttcccaattttatcttttaccggttggagatgagaaataattacacttattgaacttgctaataaatttgttagtctttatctgcagctccccttgttttctcaactttatgttgaagtataatttacgtatcataaaataaatagttaagtatttctattaatcagtttttgtaatagcatgcattcatgttaccaccacctaaacaacagagttttttccatcacccacaaacatattctttgcttctttccattcagtctctgctgaggcaacttctactgtctgttagttttacctacttcagaagttgatttaaatagaattctacaatatgtgcttgtatatgtctgactctgtctagtcagaataatctgtgttttttacattcatgatttgtatgtatcagtagatgacatcttctttttgctaagtagttttccactaaatgaatatatataacatcatattttattttcttattcttttttgatgaccattagaattgtttacaggtttggactattatgaataagtcttctgttaattttgtagaagtcttttttacacgtttttattcctcttgagaaattacctaggagtagaagtggtgaatgatagagtaggtgtatatttgactctataaacaactgccaaactgttttccaatgtggttgtgtcattttacattgttaccagcagtataatagagttctggttagtccacttttcatcatctttaagttgtctttcattatctcaacagtgtcttttaaagtgcataggcttttaattttgacaaatttaaatttaccagtggtggtttttttttttttttaataaattgggcttttggtgttagttcttagaaatcttttcctaattcctgctttcttccagcagatttttagtttttattatttcatttggacctacgatataatttgagttaatttttgtatgtggcacaagaaatgaatcagggttttacttgtgttttcgttttttgggtttttttgtttgtttttgcttttgcttttgtttgcttttgcaagtggatatgctattgttctagcaccatttgtcaaaagatcattctgtcttcactgaatagcctttacatctttgctgaaaatcagttaacctatatgtgtgagtttctttctgcaatctgtattctgtttcattaatctgtctatatatataacaaaacacgctgtctttcttactataaggcttgaaatcagatagttttcaaacttggttcttttttctttttttaaagttgttttggctagtctagtttctttgcctgtccaaataaatgttataattaacttgtcaatatcaacaatacaatcttatgtggtttttattaagatagtattgaattgggattgtataaagatgaatttgaaaagaattaacatcttaacaatattgcatcttccaatccataaaaatggcatagctcttcacttactttactctctttacttttcttccagcaatgttttgcacagttctttcaaatttttaaatcacatctatccctaaatatgtcatgtgttttaaatggtacatataattttcggaaaaaaaccatttttttaaagtcatttaatgaaagtatatataagtaaaatttatttttataactttttaatttgttctgtatgtcttgaaactttgatgaacatatttattaattccagtgcctttgtttgtagatttcactccatgttctacaaagatgattaatgccattagtgattaaagaaaattttagttcttcctttctgattgtggtatctttttctcgtgccttaatgtactgatagggaccttcagtaaagtgttgagtagaaatagtgagagcagaaatctgtgatctgttcttgatcttattaaaaaattcaatcttttaccataaagcttgatattaactgtggagttttccctagatgtcttttttcaggttgaaaatgctcccttctatttcgcatttgttaaaagtttatatcaggaatgaatactagaattgtcaaatgctttctctctgttaagcggcttttttctttggtggtttagtaagatggtgaattttctttcttggctgtcaagtgttaaagaattaatgtttgcagtcccaagaaaaatccatttggttatcatgtactattatttttatatattgttgaataaatagcactttctaaaatttttttcagaacgctgacattttattcataaggtatgttagtctatagttctcttttcttgaaatatctatttctggttttggtttctggatgatgctggctcatagaatgatttggcagataatacccacttttcagttttctgaaggttttttgtagatttgattttatttcttccttgaatgctggtggtggcacttattagtggtcatctgggcctggaatgttctttgtatgagtacaatttctttagtaaatataagactatactaattatttgtttctttttgagtgtactttggtggtttttgtctttcaggaaatttgttcatttcatctaagttgtcaaagatattggcaaaaggtgttcattctactttctgattattcttttagtgtttttaaaatctgtggtaatgtcactacaccattctcttccttctgattttgataagttctgtcttctctcttcctttcctaatcaatctgaccaaaactttaacagttttaaaataagcttaatgatattcttaaataactaaccatcatttggtttcctttcaacaatttgtataaatttaaggggtacaagcgcaattttgttatatgcgcacattacctcctaatgaagtattgactttcagtgtatccatcacctgaataatgtacatcgtactcattaagaagtttctcaacgccttccccactttcacctcacccctacttccaaatctccagtgtctatcattcacactctgttgtttttctgttttgtatttcattgctttttgttttgatatttactatttttaaaacttactttgggtttaattggctcttctttttctggtttcttgtggtgtacactgaggacattgttctgagaccattcttcctttctaatactgagactgagactcaatgctctaaatttttccctgagcactgtttatcagaatcccataacttttgacatttcatttttattcagttcaaactactttctattttccatgttgatgttttaaagctttgttatttatttaatttgaagctatttggagattttccagtgacttctatttttcattccaatttagttattttcagacaaaaaattttttcacaatttgaatctttaagtttattgagaattgttttatggaaaaacatatggcctaacttgaaaaatgttccatgtacacatgaaaataatgtgtattctgctgtcgttgggtagagtgttccacccattttaattttgttaagttggttgatggttttcatatctttaatagcctttttaattctggctacttattctatcagttactgaaagaggtgtattaaaatttcctacaataattatctgtttctccatacaattctattaggttttgcctcatatattttgttattaggtacgtaaatgtcgtaaactagcatggtgtcttaatgtattcagtctttcatctttataaagtgacttttacctctttgctctaaaatctcctttttctgatgttaatattgccactccagttcttttctcttggtctagtgttatcattacatatctatatttttaaactattctttaccttttgtatttatatgtgtatttgtaactaaagtggatttttttttttttttggtggggagctgtatttatttcccagggctgtcagaacaaatatccataaattgggtggattagaacaacaaaaatttattctctctagagaagaacgttttcttgccactccctggctgctggtcattgctggcagtccttgtccttccctgactagtagctacatcattctcatttctgcctctgtcttcatatggctgtcatttcactgtgtgcttgtctctgggtcttcaagtggcctttttataaggacactggtcattggatgtagggcctaccccaatccaatgtaacttcatcttaaataatcacatctgcaaagaccctgtttccaaataaggccacattcacatgtactggagttaaggacatcaacatatcttttggtgggggcagaaggggcaattcaacccataatagtctgcctctaggctctcaaaatttatatccttcctatgtgcaaaactcatccacccccgtcctaacctacacaaaatcttagcccttttcagtatcaactctaagttcaaaacctcatataatgtcatcagtttttaaaagctccacttctcattttctaaatcatctaaatcaagtctggatgagagtctgggtatggcctactctgcagtaaaattcttcatgtgtggagctgtgaaattagaggataaattatatgctttcaaaatgcaagggtagtaatagccataggattgacacttccattttaaaggagagaaattggaaggaataaaagggtcacagaccccaagatatttggaaataaagcagaataaatcccattagttttcaaggcctgcaaataacccactgtagcttgtcactctgccctctgggtctacagaagcctaattcagcttcagaatctgcaaccctagaggccccatcagcctctttggtctcaaggcaaacttggagttattcttcccttttcttgaagaatcacacatgttcacaactcattagctctatttgcctttttgctgcctgtagatctcagaagtctgagagactctccttcatttcttctcatctctgttccatcagtcaaagctggcaatgtcttttgtgctatcacattaagtagtgaattcaacagttaagccatctggtcctggactttccttagttgggagattttatattactaattcaatgtttttggttgttataagtttgttgagagtctctacttgagtcagtttagttatttacatgtttctaggaatttttttatttcatctggttgtctaatttgttgacatataatttttcatagtgttttattgtaatcctttttcttccagtggggtaggaagtaatgtttctactttcatttctgattttagttatttgtgtctcctctctttttatcttttttgtaagtccagctagagatttgtcaattttcttgttcctttcaaagaccaatttttgatctcgttgattaaaaaaaaattataagcaacaaaacaaataaaaacaaaataaaatgaaagccagagtgatagtgagagtgagggcaaggtgggtgggggtacagggaaaataaccacttctcctggtctttgcagattggttctgtgtcaggaccctcctcaacacttagacaggtttgcactggctagacaacagcccacgatgaaaactcaaggtcttctgaggcctttgctgagcatgtgtcttttgggtacacatgtagctttctgaatttctcagcatacttgtctccttttgttaatttctaaagaaacgctccctagctttcagttttgactttaggtagtctattgtatgctttgacagtcagcttttgtcataagcatctgagggtccttactttggcttgcaatgttcctggcaatactagctgcctttccagcctgagtttccagtttggcaaaacagagataaagaacttatgtcactcctacaggtagccctacacagggcagaactgataaacacaatattttctaataagatcttattcttttcactccagaccaatgggaaagggtcccacactgggaatgcaagctatagacacttgaagaccaagactgttcaaagagggtaaggtggcaggtcgggaggaagggagagtacaaaggtttcctagcattttaaagtaccattttcttgattctgtatttttttgattactataatgttttactgtattcctgaattctgacaaagttggttctgacaatttctgcttgtttccaatgtttctgttgggagacgaaaggttggagcttcctcatccatcatttcgcacatgtctaggtcagaagtttcctgattactgtctcttcaagtatttcctctgcctcatcctgtccctgccaccctctgaagctctcattacacttctgttagacatttcatgttttatctcagatatctgatgttctgtttatttcattcttttttgtctttgtatttcattttcaacagtttttatagatgtgttctcaagttcattgaactttcctctgctttgtagagtcagttgttaagagcagctaataaattcttcatttataatattttccacttctaatattttcatctgtcctttttatttctatctctctgctgaagtttgcaatttcttcacccatgttgtctacacatccactagatccttcagcattttaattacagtatttcattatcctgatttttaacaggatgtgttccctctacaattattctttgtatttaatgactgaagttggttttcctgattgtgacctctggtgttttaaggactttggttttaatttgttgtccaactcttggcttcaatttgctctccagggctgacaggtgttcccaagctctggcctgggactcatgcttagtcagtgagattctttttatacagcatgtaatggagcacagcaaaccttctctgatctatatccccatccctctctccgacacccttttgagactggtataggccccttcatgtagtaggacacttagttatgatgtcgctacattgaaacacagtgaataatagtataagccttagaatagatgcacctgcacttaaatcccatcttcatcctttataagctctttgatttggggaaaactcacttcactttttcaagccttggttccttaaattgtaggttagacagaaaataatacaccttgtagaatcattgtaaagattaaataaagaacaggggaacacagtgcctgacattcattaagcagtcactaaactgtaattgttattatttgctttatgactctaacctcactgagctttaatttctttatctgaaaaatgatggttatgttgtataatagtaacacagtatcatgtgcctttccctataaaataacatgataattttaatgactaaaattcagaacacaatttacaaattaaaaagtgttcttacacagatcacatttccccagaaactcaaaaggcaggtgttgtgttcccttcctgtagatgaggaagctgattctaggagactgctaccagggtgggtcataagccagtgtctgtgtctctttaatcctggttctgtgctttttacattgcatgagtctaaactctgcagggggaactcaaccgttcctattctttaggccaatatacacatatggtctcatgatttcctttcatttcccttaatgcattctaaacgctgctgatttgctgttttatggacttcttggctgtgtttctgagtatttttccatgctgcatttcatttcatcatcttctgtctctatttccaaatgtagctatttgttcagcctggttttgctctgtgaggtgttatttacaatacttactaatttaatctttgttcggggaaatccaaggagcaattgcatacttctgtgaatcattgataattcaagcctggaaaaattcacctagcactaggatcctgctctttttttgttcagtgccatatgtatatatagtgccatacgcatacatatgtacagccttattccattctatactgtaattgatgttattttgattgttttgtagccctttgaagcagatcccattgcctacaaaatgaaaatgggtaaatatcattcacaaaatggtgattgattgcaagcacggtttaccatacatctaatatgaacagtaatgtattccctaatcacaaattctggatacaaactcagaagccaaaaatgtgtgacacttaaaacttgagaaagccaaaactaaaagggaattcacccagccattttcctgttcccagcagatgaaacatacacagcaacctgcagtaagtcacatatgatgcacggcacatgtgggcagtcagagcctaccaccacactgcctgtccccagacctttctggaaagcatccttgtattaactctggatttcattctagcattatttatctgactgtttcttcatgtacatggagttggaggctttgttaaaaaatccacttaaaatactaattttaactactttcccggtgtgtaatgcatttctaggatgcattacttaatgcagtacatcaattagattatagaatttaacaccggattcaaatatatatttatttggttagaatagcaagcaattataggaagaactcagcctgaagaaggagttttagtttcccatttctgtggttggctactactaataatattatagttgctatgattttagagtttgactaaatatcaggcactctgctatataaatacttgctttttttttttttttgagacaggactttgctccattactcaagttagtgtgcagtagcgtgatctcaactcactgcaaccttcacctcctgggctcaagtggtcctcctgcctcagcctcctgagtagctggaactacaggcatgtgccatcatgcctggctgatttttgtatttttgatagagatggggtttcgctatgtcacccaggctggtgttgaactcctagactcaagggatcctccctcttcagcctcccgaagtactgggattacaagcttgagccactgctcccggccaatacctgcttttctttaatgggtgctggtgaggttaaaatgaaattatttctgtacaaggcaactgaatggctcttgagtaatcataaagaacattgtcatggtttagatgcgtgtctccccaagcctcatgttgaaatgtgatccccaatgttggaggtgggatctactgggaagcattaagttcacaggggcgggtcctttatgaagggcttggtgccatcctcacaataatgagtgagttctcactctattagttcccatgagagctgattgttaaaaatatcctggcatctcctggtcacacacaggttccccttcaccttccaacatgagtggaagcctgaggctttcacctgacacccaatcttccagccagcagaactgtgagccaaataaacatttttccataaattacccaacctcaggtattcatttatagcaaaagaaagagatgaaaacagacattaaatgttatatatattttttaaatttttgtttaagattttttttttaccagtaactgacaagctaatttagtatacactgttcacttaatatgtttttcagtcttcataacttagatcttgttggattttcggcctcaaatattcttactcttttccatcaagatgtctgtaaatctatttaatccttcaaagtataatccaaatccttctatccttgaagattttcagatttttccaaacaaggtaatttctttttcctctgaatattcatagcttttaaatctctgccatagcaattgttttctactttaaattgccactggctgcgtgcctctcttatttgctcttgtgaactatgagcccctcaaagccagaacttatgctatataaatattttttctctctctctgaattaaaaaaacagtaccatatgactctcagtaaatagttgataggcattgctgaatgattttcaattttatctaatatcggcaagggttgcaggactgcaaaatattttttcactactggttttgagaaaaggtacaacggatgaagtgttcaatggcacttcctcaaaaacctgttgaagttctatcatttggcagttggctaggaatcatacagggcatttatctttgaaatcagtgttctctttgtcttgaaaagggtaggcctgtcatgctggctcacgcctctaatccccgcactttgggaggccaaggggggcaaatcacgaggtcaggagattgagaccagcctggccaacatggtgaaaccctgtctctactaaaaatacaaaagttagctgggcatagaggcacacacctgtagtcccagctacttgggaggctgaggcaggggaatcgcttgaactaggagacggagcttgcagtgagccgagatcgcacccctgcactccagcctgccatctcaaaaaaaaaaaagggggtcacattaggaattttttttttttttgtaatgcttatgtataagaaaccagcttggaactgagagggaagtgttttattagtcatgcaaattgagtttattagcaagatggtgcccctgtagagtcaggtaaatttagtgtgtgtttgtttatgtgtgtttggtatggcttttgtgtttttctctacatttggatttatagtgcagtctctaaaaagtattgcttcttttgggaaatgtgtctctgaaactgcctttgaagaattataggtaatgagataaatctaatatgaatgactccaccttgcttctaacctcacagactatttttattttcttaatctagcatggaggccaagataactatgagagaaatttagttttagttaaactttgaggctagggaaattgcccctcctccttgctggaagattgaagccagattcatagggcaatgttagaattatggcacaggttgtacttttctaaagaataggcattgttaaaccataacctgccatggcttagcttgttttcctgtaagttgtttgctgccccaaagtcatgtaactgggcttgggtaggtggggggtgttacttcccacctacatcatcaccatagacaacatcaccactgagatatttttcagatttagcatttcagcagaccaagagctgccaccaagttctgagactccctcccaaaaactgactcagctgcatgaaggctgttttagacacctctgtgatttcatcagttgtttcagtttcccagccccctgcttgccaaagtaccctaaaaaacccacaccttcaaattctcatggaagggtgggtttaagaagtttctccctgttctcttcacttggctggcattgtgatattaaactcatttctttgctgtaatacctgttcttctcagtacatttgactttctcggcagcaggctagatgaacctgttgcactattaccactcctctatccaaaatccaccagggcagttatgggtcagaactttagaagatgacagaaggcgaaggtcatctttactttggatcccagaggacaacaactaaccagttagcagtgccattgccacgctggtttgttctatactaacccataaggaatgcttttcagtgaaaaacctaggctctaagaaaacagtgatcaaatactttgtttgcctccactaggtcagagagtaaggtgaggcacacttggggcctggggtgagagattggctatcgccagctgtgcattatagagaagcactttgcctgcagaaggaagggaggcttctgtgttgaggaaagtgctatcaagaaaattaacttagagtgttttctgagaataagcaagagggaaagccaaatcatttataggggaaaatatggaaaaagttgaggggatttagaaattttctagggatggataatccctcttccaaatgtgaaaatggcctttggcaacttagaaaagcaacagaatagaatgatttttcaattcagagtcaaggattgtggctaaggttctctctcttggttttgggaggatgatgtctgcaggacagagggaaaaagtcagaaagcggacataccagaactgtgtggcttcaagcttatgggtagaaccattgctgccagtgcatctaggtatctgctttttcaactgtgaccatatattttggtgttataattattttcttaagaaactatacgtttttattggggcttactatgaccccagtattttatctaggtaggttataacattaaatatagtattaggctcactttattttattttttattattttttaaatttggggggtatataatagctgttaaaatttgttttaagtagtgttcctcaacagagcctaaaacgcaagacaaagtaagtgaaatcttaaatctaattgcttcagatatgtaaacattttatagaaaataaaaacaacaataaaacaaataaacaacatcactaccacccccaacaaaacaaccaaaccagccaaaaggatcaagatcttgtaagataaatggacagttttttatattcatacctagagtgtctgtgatatttagtattaatattattatcttccattcagcttcgtttaaatatctttcaacatagtctaatatttcaataaatgaattatttttctgggaaaataccatgaaacattgcattctgaggctcatccaattacattctgagcaagtatcatcttacggaaaagaaacaagttctattatgccattgagttgagcacttcatatccattttttaattcagtctccttaacaaccctgcaaggttgttgttgttagcttcattttatagttggggcaagtgaagcttgatgacatttggtaacttgtgcgaagagaactagagttcataaatggccaaacttattctaaagccaagtctataggcttccacagtgcatttcctgaaccgccatgctagacaccccctgggtaagagcgcttctaactccaaacttctgtgatctggagaagtttggaaaagcaacagaatagaatgattattcaattcagagacaaggattgtggctctcttggttttggaaggatgatgtctacaggacagaggaaaaaagtcagagaaaaaagtcctgataatgagaattgacaaagcactaaaagatttttcacctttaaccaaattttgttctatgtccctggatctttctttaattaattatgaaacttttgattgcttaagtatcatgtatagttttgactttatttgagaaatgtgcattttgggtaaactcatcttgagtataatgattgttatgtttactagatctaagaaattaaaatatctaagtctttgtacactaaagaagtacaggattatttttaagaaagcaactcatatgtttgggaacatctgtatacatcattaatattttcttttgtttgtagatattcattattatgtagacaccactctgctttaaatctttgaagatcaattttgagaaatttgatagtgtttggaacaaacagtattctgctcaactggcatgagtcaaaggtccacattacccttaggaaaaaaaaaaaaattattgctttctgtgaggggttttaaagatgtgacatttttcaatatctgctttataacttttgatgataaaaacaaaataataaaaaattacagcagaaaacattctttgaaggcttataatgtgtcaagttctattaaaaatgttttatatgcatatttaaattcatcctcatagcatccccaagagatagaggctattagaaccattttacagttgggccaaattcagtcagctcagaagtgacagttctgggaattttcttctccagagcccaagattttaaacattgagcatatttccttctaaagcatattgccaaatactatagaaggaccgtgaattataccttgtgattcaggctaccatcttgaaactaaattatgagtgaaaacattttgtttggttacattttttatatttaaaatacatttgaaaagaatttggaatgtgttaaagtcagagtcatatattgagacctcgtatctgaattgaattactttaaacaaagtggaaagaactttttccatcaatttgaaaagtaaagtaaaagacagaaagaaacagagagattaaatgtttttcccttattttgtatattgtgggcagtgccatttatcttagctatgttaataaacactggattttcagaaggtttatgcttcatccttgctttatgctgtaatgtagccacacagaatgtctctttatgttgactgaagttaatatatgcatcttaccttttaatattgcatcaactatagtcatagtggtggaaaataataatgctctgtgttctgcactatggtggatgttttataaacagtatctgcaattattacaaactcctattagagagctatgtctaaccttattttacatgtaagacatagaaattcgaagttcccagaatcagtgagtagtagatttgaactgagttttaacacaactctaaagcccaagcctggcctccttccgctgcgcaattctcctccagagggaaaggctagcaccatccctaagaggggccgaaagtcttctaagggcacctgaaccattgtgaagaattgtgttaataacccagtaattcacacttgttcaaattttcagacatttcctgggatgcagtcaaaacttttaggagtctgaagcctgaggctgcctgctctctgctgctgattatagagctctctagttgatgagtggtgtcctggagctccctggccatacatacacagtgctcatgggtcgactgtatggcaccagcctctgctgctctacccttttcagcctttttttctggaatgcatgctgaggtcctccttgtgcctttgaaatttttatgaagagggtgattatttttggtacagcaaaatatgtagaatttgcacttcttaggaattaaacatctcaatttttttcccccagagaaaataactcttgagcaagggaacactcatctcaccgctcagactttgaggtggccctacatgtatacaagtttgggggaacatgagaattccaattaaattctgggaaatccagacatatattcaacaagtatttattatgtgccaggcgttattttgagtgctagaaatataatggcaaataaaacgaaaagaaccctgatcctgatggagtgtgcgtctaatgagaaaaatatacaataaggacataagcaaataaattcataatatagcatcagaggcgataaacagtagaaggaaaagtacgtcagtgtaaggcacagagagctcccgggggcagagtgttttcattaggtggtcagagaatatcttgtttttttgtgagcagcttcagccaaagtaagtaatcaagaattatacttgaaacgattggtttccagatgttaagtataacaaatattaaaattcctcggtctaacaccctactcatcttccagctgctttaattagagtagtttctatttgttctacaaatagggcttccttgtaaaattttctttggagatgggtttcatatctgagagcactgcctcagaccaaataaatattaacacaggaggaagctgagcgtcaaagggaagcagtaacttggccaaggatgccagtgctcccagtggccaagggaaacccaggctgcggtcctctctgtccaagctctgtcctcggccctcaggtcctggcctccagcactgagagcaacacagagtgcctgtgaggcggtctaacttctgctgactggtgaaggtggatcccccagccccaggaaaagtcaaccagcagcttgaacagcgcttccctcgcggaggctcagcactcagctcatcccccgccatcgggctgtaattcaggtgccagcgttgctcctccagcaggaacataagcccaaacttaacaaattcctaaagcagaacaaagaaagtgtcagaggggaatgggcacggagcctgtggaccgcactagaatcttctaattcttaggaatgcagatcgccctgtgtaaggggccgctcagagcgcccgaggagcgccggtggcctcccttggatgcttcgctattcatcccaccttctggaagaggctattcttttgtggctgtcttggtgtttggctgagttgttattgaattcctccctgacttcttttttttttccttcggaagacagaagaaaagaagccggcagtggaagtcttctctgggaagcctcctcctcctgcatctggctgctccctttggggcagcctggtccgcctctctgggcgccaggtgcgtctgcagcgctctcctggaggccggctgcaggttcattagtgctcacaataggcacgcagcgcaggggaatatgtaaagaaagtggaggacatcggagtggcattcaaagcggcaggcgggagtaggagtttccctagcttttcttcctttgtttctaatcaccttttctgtttcttcagagaggatgctaatagagtgaatacctgggcgttccaggagaagagttagtggaggtttcagaaaaggaaatgcaatctgggacgaaaaatagcttttcttccccttggggtgtgtgtgtgtagtgtctgaatgctttgccaccgatgaggccgaggactaaaagcaggataaaggctgtgattggcacagaagacccctggtgaaatttctggctcaggtactagctttctgtgagtcctgtgcaattcggcacagcccttggggctttgagtcctttttttttttttttttttaataaaataagagacttggctaataggatttctagcctaccactcctttacagttttaagatatcattttaaaaagttacatttcaagactgtagtaaggaggtgacattatatacttaaacataaaaatgtggagtgatttgaagagcactgaaattattccactcttcaaagtatatgcatttatgtatacatacatgtacatacacgtgtacataaacaaacatatacatatagtcattttcagatgcctgaaattctgtccttaaagacagttgtgaatcccagttctattagtatttgactgtgaccctcttagttttgcctactgtctgcaagactcaatttttctttttttcctcataatgggaataaatattgtctgtcttctaactgtgttatgatatttaaatgaggaaatgtgttgaatggtagttcttcttgtctgaaagataagaatacatgggtgccatcatccaatctcaaagtcattgggttttgacagaaatggtatgatgggtaattatcccatttctccaaagtcattaggaacctgaagtaatttttttaaacttgtttttcatgcacctgtgttggctagatcacagagcctgggcccatcctcttgaggaaatattatctgcgtcaaccttcctcaatgcctcctggatgactttaccaccatcttgcaaatgtctattatttgttagctctagaagactcagagcaatgattgcaccaatctgaaggttatttcttccatgctggtcttctgccattggtgatattacagatgtttgtccagaacattactgatgacagctacacacctggaaaataaagtttcttgtttgttccttccaaattaattttctgaatgaacaccagcaactcaaaatgcattcagtttcagaattcaaagaacagaagagcaaatttgagggacactctggcacagtagagggtatgtacaatcattgaatgcaaagtcttttacattttaccttacacgtcaatctcagctaatcaggctttatttttcaggaaagtgctgcagagcagagaagcaattctcaacaagacaaagctactataatagcgacttgtggagtcacgttaagaagaaaataggcagagaagtggactcttgacgggagtctcatccatcatttcctctctgtgcaacctcaggcagggtacataatcgatctaacttttagttttctcttatgtaatctggagataataacatatattttatataattattgtgagtattaaataccaaaacccctttatgtcacatgtttagcatagtgtctatatcacagtatgtgcgtcatatgaaactcagtgctttgtacccgctgattcctggtgaatgaaatacggtcacacatcacaatgactgtctgctgaaatgccaaaatcctgcctgtagttcaggaaccagagtaaaggaaaatgaaccctgtagtgtttttactttttctctctttttagagaaagatcatttgcatgtggctccaccttaataattgcatttgtaatgctttcatgttgtcacatggtctaacccccaggatcttatcttaataaaaattcagttaaacatgtgttcaaattggccagatcagccaaatctggaacagggaaagttgttttcctcctaatgaactgtcccctggacacgggcagtgccacagaagttcaggaatatttattgtccatggcatttccaggagttacactctttgttgaacccttccatcgtgccagggggaggctggtgattcattaattcactgtgatgatttgtcctaattattctaattactgccttgtctcctcagaccagctggtgcctaaagcagagggaaagtcaccagtcatgaggactgcggtggtggctgcagaatcccgggcactggatctgtaggattcactgtcaccacatcaaaaaagctttgctgctgctgctgctgctgctgctgctgctgctgttgctgctgctgctgctgttgctgctgctgctgctgctgctgctgagcccaacttatccttggtgctgctctggcctgagtccgggttcccggggccctgccatgcatgcattctctcctctgctcctcttgtaccttttcagggagagaagagccctgatacaggttgcttttctgtcttcccagcttgctgccccaccaattccagacagcatctgctgtgtgttctttgtgcacccatccctgtctgaacgtatcttaaacccagtctggtttctaacaactgtcgataataaaaatatctatttcttactgcacactatcaagtgccaagatggatgttcattgccatatgtgcactgtctctaagtgctacagtttgcagtcttagttcatatattaaggctctgcatgacctagagactagtttacattgcccagcaagggagtaacacatggaactgaatcccagattgctgcatccccaaagtcggggggccctttatgcgtctctcttttcccctcccacaagccttcctggtcatctacaggactcctgctgaaaccttccttcggtcttttatccctgagctcctttgctgtgataacatagactgttctgtctggcagccctgggcagtcatcagtgttggctttgcaggtcagcttggggtccccaaccaggattcctgaggccacagaatcttgctgcaaacacagctagtcttggagaactcatatctgtgcctttctgatgtgctgtatcaccccagcctgccctgtgtttctttgggatattttcacagctcatacttcagtggtatttgcctcttaagtcacttaccccttattactctgaacaaaactggaatccgaaaaaaacaaaaacaaaaacaaacaaacaaaaaacactggaactgtggctcatctctcagggaatgagctgacacttagtagaatctatgacatgagggctatgttagagaccctgaaatgaagctgggtgaaaaatatcaaggtgttgtgagtgacaaagatgatattccaaagattcaactgagaaagagtcagtgtatcttattattaaaattgcttctgtaagagtcatcataagcttgacttgtatttcttgaccaactcttatttctattcatatctcagcttaactgtcatttcttcaaagaggcagacatcccaactctacaaactgtaggccaccagcttctgtcattttataagaacaggtgaatcacttcacacttgaacttatttacttattttctttttcttttttttcttttcttttttttttttttttgagacagggtctgggtctgtcacccaggctaaagtgcaatggcatgatcaggcctcactgcagcctcgatctctccggctcaagttatcttcccacctcagtcccccaagtagctgggattgagggcatgtgacaacatgcctggcttatttatttatttatggaggcaagatcttgctatattgccagggctagtctggaattcctgagcttaagtggtcctcctgcctcagcttcccaaaatgctgggattacaggagtgaactactgtgcctggccttgaacttattttcttaatgcttgctttcccaagtaggctgaaagctttgggaggctaagaggcaacattttgtaattacctgatattcttagtgccaagagaaggctggctctgggcaggccgtctgcccatgtgctcgacaaggcctgtatttatgtatctgcaggcaggcccctcatttgtaggcgactaggtcttcttagggattcctggccatactaggaggtcatctgcagggacgcctgcactgatggggagtccttgagagccagctgactacagctctgggatgatgagggtgggaaaattgtccagttagaagaaatactgaaaacctcaatggacaaactggaacttcaggaagaatggtggtggacagaaaaaaggaaaaaaaaaagagaagagtgaatgaaccaaagtgaatgagcctcatttctagatctacagacttttgataacacctggcctgtttatatcacaaagctgctaggctttacaaaacaaattcaaaacaaaaacaacaaaaagccatgaagagctatctacgtgcaagaggttttatatttagttgtgctttattttactaaccaaactgaagactagcttgctgggttccatttcacactgccagctcttcactgtgtgcattcatgagcctgatgctaatgagacctagagtgatctcataggcaacttgcaacgttcaggctggacaggtaagtgtgatgtgttgtgttcaaaaggaacagatggtttaaatttaaattcaaattttgaaggaaacacaaagacaaagtgaaactctttgaatgttagataaaaatgttgatatttattaatgatgatatcagatttaatggaatttggttgaactattaaactgtccactaagtagaaattaatgccagttctttgatctttttatataattacagtaataatttagacttttcttgactgcaactctggggagatgtaatgatagaaaaaacaaaccaaacttcagggcatattcagcatgatgtctgataaattaatgctcttgatcgtaatttgaaaaggagctcttgccctgcaggaagctgaccgggaaacagaagctttattagtgcagagatggcattgactacacctacggtttatctccactctgctctgaagcagcaaaagtagtgagacacggactgaaacaggatgttagttttctgaaggagcagatacatttaagcccagcttcatgcagtggaaagggcacaggactggggctaaggaaatgtgtgttctacttagagtgaccaaggaatcagtcaaattcttttttgagagttaaggggaatcatttaataattatgttgaggtaatacgtgtgaactagaacgatccttggcaaatcaggaccctaatttggctcaagactagtcacttaataattctctcatctcatgtgattctcttagctttctcggatctcagtttccttatttgttgcaattcttgcctgtaaacccttaagagtgctaagagaataaggtaagagaacatatgataatgaaaggttggaaataggaaggtgaaaatagtcatttggtagcattgttctgatgaagagggtaaagctaattctcccataaattatttgtgtttcccctgttgaccagaagaatgaagaataactgagacaaaaattctatttatttcatagcatgatgtggccacacattctaaatgttaaagccttagttttgggttaggagcttacattttagcaccaagtttccctgttattatttttcctataggactgtcaagatttaggcaatatggccgctttaaaacataaaaattaactttactcatcaaaagcacagatgactaccaatctcaagcttttagtccaaatgaaaattcagtgtaaatacctttagtacacagaattccagctgaatgggaaaaaaaactgattaactcatattgtattatttggtgagaaattattctttctttggggctattgctgagtactaagaaaagaaaatgaatatccaggatctgctgctactccccaaaaaatatattattgtcttctttcttcttgaattttctaagggccccagtgagggctgggcccttccacatgccgtggtagctaagcttcagagccagttgccagggatcggaggctcagcaaggctcaggagagtatccaaggtcaaacagctaacaaggaaaggagcaaagactgaagcaggtgacaaatcctctatgctctcctctaatccagtcactaaccctacctttggtaggaatctggaaataagaggagagattaagtacttttcaaatgggtacaaaagggaagttttctgggattttaggatggtgtgcatatatgctgaagtgtgcttgaaaacaaaataaaatgcaggtgtggaagaatttttaaaaaccattgtaaccaaggggttgattgactaatataatgttagcaataatacttgccatctgcaattttgccattctcataagaattggtttagcttaaaaacattgaatagctaagcatgtgtttaaaaaactctactttaaaataaaatagatttaatatgttatttgacttcagacaggtcttatgtgatgatttgatatagatcatcaatactgaaatgaacctatgtttcatttgagaatatctggaaaagagaagtgtgaatgtcagatttcaaatcaaattatttctattttaaaatataatcatcacaatacttttaaagctcaatgagcttattttatcctacatatgcaaaccagagtaaggttaagtatgcaacttcatcttgccaacagctgtaagggtgaccatcacctgggaactcccaaaaaccctaaaagcacctggctgggctcgcttgcctgaagcaaagatgcccagtgggaggatctcgctccatgaagaggcactgagagggccagtgatgctagcagacagagaaaaaggcattctgctgcaggaaaagggcactagccaaaccgggtgtcccacagatcactagcacactatcaagttggtgggactgtaaactagttcactagttcaaccattgtggaagtcagtgcggcgattcctcagggatctagaactagaaataccatttgacctagccatcccattactgggtatatacccaaaggactataaatcatgctgctataaagacacatgcacacatatgtttactgcagctttattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaattgaacaatgagatcacatggacacaggaaggggaatatcacactctggggactgtggtggggtggggggaggtgggagggatagcattgggagatatacctaatgctagatgacgagttagtggggcagcgcaccagcatggcacatgtatacatatgtaacaaacctgcacattgtgcacatgtaccctaaaacttaaagtataataattaaaaaaaaaaaaaaaaaaaaaggagagcctcgtcaacaagatggagtgaaggtagacgggtgcttcagtccctgtaagacaaggcagggaccggcagggctcactgagcacttgcaataagttatgcacagagaccttccctatattttttcatatatgttttactgtaacccgatttagtagatacccttttataaatgatgagttcctggaattcttggaataaagagcgattagattgcttgcccaagatgacagttataagtgatgaagacaagatttgaccttctgtagtaggatttctctttctgaatttttaaccactcacaaaaataagtgctttaaaacctagaggatttgaggattctaatagttactagaggaaagagatgaagaagaggaaatagggcaaatttttttagtattatattctaggccgattaaaaaaatctattagtggacttgatcatttgttacaaaatttcctgacttttttctaatgaaaacacagagactcagaaacattaaacaagatttcaacatcactcagctaaaacaaagatgaaaggaattttgcatctgtgattgcagtcagtattctctccactattatatgctgtggagatatgactctctgagaaatagtgaaacagaaaatattggcctcatatctcttcttgagtggtactggctggtgcacccactttcttccattctgcatttttgaatattgaaaggcactgtgtttcaacatttctctaactctgccctcctaaaataaaagcctttgagtctgctcctcacctgacggtcaaaatatatctgtgtcatgccatagtccctcggacttttactaggggacttattgcctaatgttacagacacattttatatgtgtttagtatggtttaatataacgtgctccatcgggggaattggttttaaattgtgtctttatgagaggaaatgatttatttattcaacactattggttgaggtgtctctctggaccaggcactgggtaccttacatgttggcatgtctgacaccgtggcatatttagtgtggcatctaggggtcatattttctattttggttttttttttttttttgagacagagtctcgctctgtcacccaggctggagtgcaatggtgagatctcggctcactgcaacctccacctcccaggttcaagcgattctcttgcctcagcctcccaagtggctgagactacaggcacgtgccaccatgtctggctaattttttgtattttagtagagatggggtttcaccgtgttaaccaggatggtctcaatgttctgacctcatgatctgcccgccttggcctcccaaagtgctgggattacaggcgtgagccaccgctcctggccatattttccattttaatattagggagtatattagagacatagctgtttctcacatagaattatctgtccctactgcataagttaacataccagttaggtttccccaaagctcccatccttgtttctcattcctgcttttagagatactggggacaggagaagtctggtcacctctctaccaccaaggagccaaatgtcaattacacaagtcctccgatttatagtttctccattaatagagtatggctaagtgtttatatttctgatttcttaggtttttcatgaagatcatccaggattgtagatgaaaaagtactataaatactgaaatgtacttatcctatgtaacatcattattttatgtaataaatcaaggcctctgttatggtttgattgtggtttgttcctgccaaaatttatgttgaaacttgatccccagtgtggtagtgttaagaggtggggcctggtcttgggcatgcaaccctcatgaatagcttaatgccctctcaaggggtgagtgcattgttgctctcatgagaatgattagttctcctgtgagcaggttgctaaaatgagtctgccttcctaggtttctctctcttgacatatgatctcttttcatacatccccctacttttgtttttcccattagtggaagcagcctgagacccttgccagatgcagctgcccaatcttagacttttaagtcaccagacttatgagccaaatcaatctcttttctttaaaaattacccagcctcaggtagtgtgttatagcaacacatagactaagacattctctaagccacatccctgaaaactgttttagaacctgcatctatataagggctttttaatatacttggtgtcagaaacccaccctttcctctagaaaatatatgaagagaatagataccttgtggatgacttctctcccacttaaacttcaaactgatcatagtaatcaactccctgcccattcctctttcttacatctggattttcagtaatcaataataacaatccagtaatggtgcagctggtatggcagaaaaattattgcagcaaaacattcacaatgaggctaatgagatcatgtgagagagggaagagggttgaatcgatgttgaaactaattttatttcattagcactagatgtaaattgcagtataatggaattaatcatttaaaatggattgttcacttagaagttacaaaaataccaacattccatttggtgctatctttttcctctgatgaatcaatttggttttaaaggatttgtttgtatttaaagtaaagggaaccaaggggtttatacagcaattcttgggaacaggaatgagataagaaaaacagctagagcagaaggacatcaacaaacaacaaaaacaacaacaaactgagcagattatgaaagggcaggagataatttctacctggagtatgtgaacatggcaaaatcaacttaaaaaataagtcttctaaagacttaatccattctgagccaacctgaaaacagtgattcttaatccttcatatacatcataatctcttgggaaacttttattagatagcaatgcctaggcctcatcctaatttaattaaatcagaattgttaagagctagtactgcagaacatatataatgccaacttcctatttttattttttatttatttatttattgagacggagtcttgctctgttgcccaggctggagtgcagtggctccatctcggctcactgcaagctccggctcccgggttcacaccattctcctgcctcagcctcccaagtagctgggactacaggcgcccaccacccggcctggctaatttttttgtatttttagtagagatggggtttcaccatattagccaggatggtctcgatctcctgaccttgtgatccgcccacctcggcttcccaaagtgctgggattacaggcgtgagccattgcgcccagccaactttttaacaataaaaatcacgtgggatttgaacaaaaagtatactaatcaaaggaataaatatttatatatctcctgagctgcataaggaattatgggattaaagtggtacaagattctcttaaacagggcaattactagcagattagggatataaaaatatatgcattaattgtccgttggtggtgcaaatgttatataccagagatatttagaagaaggagaaatgactttggacccaggagaactagggaaatcttagagttaataggagatgaagcagaatttaaaggaccatgtatcagcaaactattgctacacagaaactcatcttagtcttaaagactttctaaacaaacatgctttaaagagtttgcagccacctcaaagttggtctcagcttgggttgagttgctaatgatcataaatttttgtgatgaacaatctatttcagaaagatgctcacaaatttctgtgacaattgtgactcaaagtcatttcacaaatcttactacaaagagatctaaacattcttttctctggccaggcacagtagctcttgcataaattccatcttttgggaggccgaggcgggcgaatcacttgaggccaggaattcaagaccagcctggccaatgtggtgaaacccccatctctactaaaaatacaaaagttagccgggcgtggtgacacgtgcccagctattgagaagctgagacatgagaatcgcttgagcctgggaggtgaaggttgcagtgagccaaaattgcaccactgcactccagcctgggtaacagaagctaactctgtctcaaataaataaataaataaaaacaattttttatcagcagccttgacgacaggatcattaatgaaataattctgaggaacagactcgctacatgcataattttatagaaaatgaagctgatttaaagtgtataaatgatgcagggtgtgatcaatttaagacttgaacccaacattcatggctccaaatgcagtgctcattttcctgtgcaattacacatggttttggacaaaggtcttcgtgttctattttattcatacaataatttcaatttaattaacctcaattttaataagcagttattcccaagacagaagcattaagagaaccaacattttttaagagctcactaggtctcagacaattacaagtcattatttaatcttagatgttgtgccctaagtgccttgcttgcttcaccactgccatggccctaccagcaacaagaacttatccaaggttttgtagacatttgtacccaaagagggacaaactggaaggcagtacttgatgtatgttttcatctatcactgtcaaaaacacgcgcctgaaacttccatttacatacctgtccccacatctctccttcccagtccccactgtgcttcgtgctcctattttgatgatattcaatctgttacgttctctccaccccagtcccatgatttcttcacttttacctcattagcgtccagactttacatgtgtcgtggataaaatacactttttctaagtctgttgagaaaatgataaaagtggtatctcaaacagcccaaggagacagcccaatgggcgctcgagccctggacaggcatgttgcaaacaacgtccatcagtaatcaggactgagagagcataaagcctcagaggtcagaggtcaatgggaggttccagttgggtcagaaatgaaaactgcagagaatgcagcagatacatggcactgttgaaagagaggcctagaagcagaagacaggtgagttatatttagctggggacctgtgggaggttgcaggtgatgctcagtggagatatatgaatcatcctacctgttacataggccagctgggatcaaaggaaagattagagtgtgacaaatggctttgtatccataggagtttgggttgataagacattaagaggatttaactttaatagcctaaactagttttataaacagtgtttccagataagacacagaatgcccatttaatgctgaatttgaaattaacaatgaatatttttaatacaaatatgccctaaatatagcatgagacatactatactaaaaaaaaactgtatctgaaatttaaatctaattggacatgctataatttatttgttaaatacccaaccctgtgtatagagttggaaatcaccctctttactgattataggactggatattcctgtctaaatgctaatagtgagggtagagagaaagaaaacttggccacatactctgacaatactggtataattgtaaataatgttaaactccgtttgctagcaagaattaagggagctatgtctgaaatggcactgttttgtcagtgaattctgtttacctttttcttctgtctggagtgtatttgtgaagagtcccttattatcagttatgttttatgaaaatcagcacactaccacaatgacatttaagcacagaatcattagtccatgtttttaataaacacatcgattaagaaaaaaaaaacttggccacataaaagttatttgaacttcagtttttttctccgcaaaatgggcataatctaccaacgcctcccgtagttgcaaggggatgtgcatgagataacgtttaaagtactgaacacaggcctggaaaggtagcaagtattcaattgctttcaaccactgctcaagtcaaccttttatgaaggcggggaaggctgagtgaatgggtaaataaatgttcttggtaaagcagcacaccatcagaatttcactaatattcatcacaatttattttctacccgaagctcaggatccaccccattccgtatgggaaacaatcgaaacaaagtggcatagtaagcagtcccatgacagttgtgtggaaatgccaccctttctttttaaggtgaagcagtaaagcttagcaagtagcatttgtgcctttgacaaatggtaggctgacaacacttggacgtggttgacaagtacaaaatagcattcagtaggcaggtgccagggaggggaaaacaactcttacgtattgctatctgtattgagccagactttaaagaactggaaaactctctacatgggaattaagaacatgaagatatttcagtaaaatctgttattatttttaagatacattgttttcaaaagctcgttttttggccatatgggattgtattggaaaaatattcctagaaaatataattcagcatattttgatggaaatcatttcccttcatttataagtatccaaataatccattgtgaacatcagaaattattgaaatctctaatgcagctttaataaattccttcctgtggaatatgggcgtgttttctgaagctttattgaaaaatgaaagtctcacataaaatgtatttcagatcatttaacttttctatcttattttatgatccagtgaattttattcattctagcaagtcgtgctgaatctaaacactttaggattaagattaaaatactgagtatataaattagggttaataaaaaaatccaatatatgtttggaaatgtagctactgtcacttaaaggaaatggtgcagctcggaagtagagtgtagataaattaaccaattttttgaaaaaaattgatgtccacagaaataagactcagatggtctcattgttaaaaattaaggctgatcaaagtgactcaactccctagcgaatattttctctagacactaaatcaagtgcctgtaattgcatttctatagttttattccatggtgtaatcagggtgaaaaattaagacaagtctctggacaatagaaaatatctttcagatagatttcaatttcagttggttggattagctataggaagcttgtccaacccacagcttgtatgtggctcaggacagctttgaatgtggcccgatacaaatttgtaaactttctgaaaacattatgagtctttttgtgtgattttttttcttagctcatcagctattgttagtgttaatctattttatgtgtggcccaagaccattcttcttccagtgtggcccagggaagcccaaagattggatgcccctgagctagagaatataagtacaaaagagaaaagctatgaaatgagtaataagcacctgaactttatacctgaactctaatgaaattccacaagtaggggccgggcatggtggctcatgcctgtaatcctagcactttgggaggccaaggcaggcggatcacgatgtcaggagttcgagaccatcctgaccaacatagtgaaaccctgtctctacccaaattagccaggcatgatggcacatgcttgtagtcccagctactcaggaggctggggtgggagaatcgcttaaacctgggaggcggaagttacagtgagccaagaccacaccattgcactccagcctgggtgacagagtgagactctatctcaaaaaaaaaaaaaaaaaaaaaaaaaaaaaaaaaaaaagaaattccacaagtagggtaggtactgggcaaaagggaattaagactatttgtcagacttagtacgtgacctgagttaagacactgtatatatgcaggtacatatataaacctgtatgtatcttgggagatctcctctgtttgtcttcactggacaacaaaatcatagagaaaaaatgcttgtgacacacacaacaacctctcccagccttgcacaaacaggcacaccctagagaaacaacatggttagaaaggcagccttgacgtcaaggtgacgaaaggataagtataagaccagaggtaagatcactgcttgagaagttgttaaaataatctgtcaagaaagaatcaatacctggactatgatagtgacaactcaagtggagagaagtcaagaaagttgagaaaccaaagtcagtggaataacaggacgcagaagaaagagggtggaattcaagagcagtcagggaccaggtgtttcatgatgctactcaacaagataaaaaagatataaaaaggaaagggtgatggggaagacaatgactcagttttgcataagttcaatgtaagatacttgtgggacacactaataatcactcttagcaatgcttttgatagttttagacattcagattgtccaaggtcactgaaacaatggaagtcaatgagacaggctggaggactaaataaattggatgcagggtgtgagacacggtatgcacaaaagagaacttatttgtcattttaagtggatccactgaagttctgatgtttacgatgatgctgaaaaatacacagagcaatagagaagtgtaagtaccatggcgtgttggagccaatagataacttcttggtaattttgtaagctgggtgttagaaacaactattattcgatattaaattgtataaatttagaatacataaatttatattaagcataaagataatacaaacttacaacttaccatttcttattttattttaatttataatttacaactatctatgtttgtgaagctatttacatctattttgtctatattgtggaaaaaccataatggtgtgatgttgtgtaattctttccagctctgctttcagtagcatcaccttgacaacttgaaatcacactaaagtaatcagcaagcactacaaatcagaacttcccatcccagggagctacctgtgaatcatctaccagcacaagactagttaagtaggaccatccatatccaaggaaggaatagtagaatacaaatgtgttccacttactattgctgaattagaaattcactccataatttattagtagcttaaaataacaattatttcataattaaagctcagcttctgtttctggaaagatgtgactggatagtcctggattggggtgtcatgcagttgtagggctagagctggagggtcagggctgatcaagcatctctctcttcatgtagccttctccacacggtctctctgcatgaactattttggactttttataacacaatggcctcatggtagttgtccttcttacatggtgtcccagggctccaaaggcaagtgtcttaaagaagaaggtaaaagctacattacttttcatttccttgcctcagaagtcacagaatcatttccatcacctcttattggttaaagtcacaagcctgcccagactcaaaaagagggaaaggagactccaattctcaaaaacggagtggcaaggtttaagaagaacatatgggattggagatattttggggccatctttcaaaatacaatctgctgcagatcccaaatcacaaaagagggagacaactatatgtagctaccagtaggagggctactctagaggatgcttgagaattattgctttcatcaatctgagacaaaattcacacacatgagctagaatatcatttccaaatgataggttggtaggatttgggggaattttatggagtagagaaaaccaaacttagatgataattaacaataaatattgtctgtatctttatggcttaggaaagtttcatgtctgtaaccaggaactcactactttttatttttgttttgaacatttcttctcaattcattccttgcatgagattttgtccccattttgaccatcatacttgtttgcattctcctgcttttgtctttaatgctttaatttggggatatatatccatatgtctatggatacatgtatatggatatgtatgatttggggatatatatccatatgtatatacatatgtatgtgtatagagatagacagatgatagatagatagatagatagatagtagattcttctctacttgcaatggggtgatgtcctgataaacccaccaaaagctgaaaacattatcaactgaaaaattatggttatttagccttgtgcccatgggctaaagaaaaactgtggctcatccagaatcataagagcttatcctaacctggaaaagatcaaaattcgaaattcaaagtacagtttctactgaatgtgtattgcttgcaccatcgtgaaaacaataaatcacatggcaaaccctcataagttggagacgttctgtgtgtacacgtgcgtgtgtgtagtttgttcgtttgcttttttttttttttctgttttcctgataactttagtttctatggacagcatatttagttctcacctgctcatgctgcctcaggttttctgatgatagggtgaagaagaaaatgcctctgtggcctaagttctgacccctctattaagtccaaaagcccaaaaccgtatttctggacttccaaaagtccagaaataaagatacaaagaagaaattctgagcgggcaaaatgggtactgcattgttgaataaataaagggaaagttctaagcagagtttaaattaactaacaatttttttgagacaagaccacattttggaaattttagaaaattgttttaagaaagaacatgttatggtatttattttgtattgaaaatagaataacagaaaagcttagaggcagaggttagaatctatagaaaattctttagggccgggcgcggtggctcacgtctgtaatcccagcactttgggaggccgaggcgggcggatcacgaggtcaggaaatcgagaccatcctggctaacacggtgaaatcccgtctctgctaaaaatgaaaaaaaattagccaggcgtggtggcgggcacctgtagtcccagctactcgggaggctgaggcaggagaatggcatgaacccccgggggacggagcctgcagtaagccgaaatcgcgccactgcactccagcctgggcgacagcaagactccgtctcaaaaaaaaaaaaaaaaaaaaaaaaaaaaaaaaattctttagctgttctctaaatttgataaaaattattgagagtctgccaggtgccaggttccatgctaggttcttgagacagagcgagaagtaagatagaaacaagcatctggtaggcacttaaaatatatgttgaaaattacatgatgcagtagagcctgccaattagaggctcatcctctaattttggagatgtgacagctttttatgggaattaaaaggccaaagaaagctgaaggtcaggtctagacacagtccaaaggtgaaatataattaaaaatgctcgcttgttcaacaatatccaggttgcctgtttgctcatagttattagatgattaagtatctgtaattcagttaagcattctaagctgcagaaaatgctataaaccagtgggtttttttttcattttcattttctatttttgaaatagcgtcttactctgtcaccatggctatagtgcagtggcgtcatcacggctcactgcagtcttgaactccttaaaccagtggtgcttcaaacctagctttttctcagaaaaactaggcagcttaaaagtgatactgaccaatgggtaccaaactaaatcactcaaatcagaatagctattggtatggccagaatggatttttgtcaaagcttcttgttatttctagtgtgcaaccagcactgcaaactcctgacctaaccaacttgtgttttctctttccccttatgtgctatcccatctgccaccagatagctcttggtaagatgttacctggtgtgttagtccgttttcatgctgctgataaagacatactggagactagcaagaaaatgaggcttaactggacttacagtttcacatggctggggaggtctcagaatcagggcaggaggtgaaatgcacttcttatatggtggtggcaagagaaaaatgaggaagatgcaagagcagaaacccttgataaaaccatcagatcttgtgagacttattcactaccatgagaacagtatgggggaaactgcccccatgattcaaattatctcccacagggtccctcccacaacatgtgggaattatgggagtacaattcaaggtgagatttgggtggggacacagccaaaccatatcacctggttatctgaattctgatcaagggcacttcaggaatttgggaaattttcaggtactgttgttctcaaacgtagctacatattgaaataacctagagaattaaaaaacagaaactcacttatgcctgagtgctataccctcctctgcttacaagtatgttcagttcatatggggtatggcctgagcataacaatgtctgaagcttcataaatgactggtgtgtggtcaagttgcagaaccactgtgctagaacatcctgatgataaagatctgactgtcagttcagatacaatctaaatatagagaaattcttaacagaggatgcagagtaaatgacttcaggtggaaagcacgtaaagtaaatgtgagaagaaggtcaggtggtgagtgtggggagctggggaaagcatgctcctgggctccctccaacagaagccacctgtagcctgggaccagtgtgctagaggaacctgttttcaaagaaagccagaagtatggatgcatttttatttgcagcctgatgatttttatattttggcaactaattcactttattaaaaaatactgaataagctcaagaaatctgtgagctggattcagccaaagcgaatgccagtttatgactttcctcttggaaagaaaagtctttcatgttgatgtatcacattttcgccagcttttctggggttatgttctcagaagtttcgtttagtttgctctcatgaaaggtgacggtaatgttcctcagctacttataaacatttgaagaaacttttcctctgtattcttagttttatactcagtgaaaatataagtcaagtattcataggtatttcactgttagatcaccatattgaggaatgagtgttagttcattaatgccgtacacaaacacccaaaccaaaatgtgcagtgcttgtggaatcacgatgagataattagcaatttcttcacttcccactgagcaggatgagttgaggattagcttctctcagtagattacacattagagagaaaaatgtcaaacagcaaagtaaaatgggactctacgtcttcccacacaagcatctccagtgcactaatgagctagcttccttgtcacattcacaactagcagcagatgacctaagaataagtcagagaagctttctattagaggaactttatcttgcctctaaatatatagtaaaaaagtgggtcaattggtacttacagaagatattttagttcaactggagaaacttaactattttagaaataaagaacccctggaaaagttagtctcccttattatgcatggaaataaaagcactttcttaatttgaaataagtgaattttttactgaagaaattcctttatgctgtcctcagtccacatattaaccccatgtatcaaggcctctgatctgccatctcaaccaccttgtcactgtccactaacctcttgctgcttcccttctctccttgttccacctagggttcacagtctctgctttgaatcagacattcacaggatcagacatgtgattcagggacttagcaagagggagtgatcagtgcattggcctctgttttatgacaaaccaccaaaggacatgtgtcctcacacaacaggtacacttgctttggcatacagaacctccccagatggctgtgctggaggtgagtagatggcgtgaaggaatgcctctgcacatatttgtcatttcctgtttcccattgatcaaaatctctccaaagagcacactgtctctccttctttatacttatggactatgacacttggccacactgagaactgcaagggtaatcagatcccatacactgcagtatgtattttcattgaagtgtacaaatgacagaggagttaacacttttggactgccccagtcctctggcagaagtactaatccctctgagaaatacatttctgttctttatcaactgcccagtctcaagtattttgttacagaagtacacaacagattaagacatatgtcttctttttaagaaatgcctaatcaggtcctttatccatttcagtattttattttgttttgttgtgctactgagttgcatcagtttcttatatattttgggtattaaccccttatcagatatatggtttgcaaatatttttgctcattatgtagattgctttacagtctgttgattgtttcttttgctgtgcagaatatttttagtttgatgcaatctcagtttatttttgcttgtgttgcctgtgcttttggtgtcataaacaaaatattttttgccaagaccaatatcaagaagctttttcagatatattttcttctagtagttgtacagtttcattgtcttatatttgtttttaatatgatgtgagagaaaggtcaaattttattttttttgcattggattgccagttttgccagcatcatttattgaagagattatcttttcactgttgtgtgttcttggtatttttgtcaaaaatcagttgactatcagcgtgtgaatatttctaagctctctattctgttccattggtccatatgactggttctatgttagtaccatagtgtttttattactatcgctttacaatacattttgaaaatgtgatgccttcagctttatccttcttgctcaatattgctatgggtatttgtggtcttttgtggttccaaatgaattttaattttttttatctctgtaatgaatatcactgagattttggaaggaattgcattgaatctgtagatcactttgggtagtatgggcattataacaacattaattcttttgatccatgagtggagaatgtctttttatctgtgtcttatgcaaaacaatatggaacttctttaaaaaattaaaaatagaagtaccatatgactcagaaatccaatttctgggtatatatctgtattagtccgttttcatgcctctgataaagacatacctgagactgggaagaaaaagaggcttaattggacttacagttccacatggctggggaggcctcagaatcatggcaggaggcgaaaagcacttcttacatggcggcagcaagagaaaaatgaagatgcaaaagtggaaacccctgataaaactatcagatcttgtgagacttattacctaccatgagaacagtgtgggggaaactgcctccatgattcaattatctcccactgggtccctcccacaacatgtggcgattatgggagtacaattaaagatgagatttgggtgggaacacagccaaaccatattgctctgcccctggcccctccaaatctcaagtcttcactttgcaaaactaatcatgcattcccaacagttccccaaagttttaactcatttcagcattaacccaaaagtccacagtccaaagtctcatctgagacaaggcaagtcccttctgcctatgagcctgtaaaataaaaaacaagctagttacttcctagatacaatgagggtacaggtattggtaaatacagccattccaaatgggagaaactggccaaaacaaaggggttacagggcctacgcaagtccaaaatccatcagggcagtcaaattctaaagctccaaaatgttcttctttgattccctatcttacatccaggtcaggccactgcaagaggtaggttcctatagtcatatacagctgtgcccacgtgaccttgcaggggataacccccctggctgctttcataggctggccttgagtttctgcggcttttccaggtgcacggtgcaagctctcggtggatcaatcattctggggtctggaagatggcggccctcttctcacagcttcactaggcggtgccccagtagggaatctgtatgggggctccaactccacatttcccttctgcactgccttagcagaggttctccatgacagccccacccctgtagcaaacttttgcctgggcatccaagtggttccacacatctgaaatctaggcagaggttcccaaatctcaattcttgacttctgtgcacccgtaggctgaataccacatggaaggtttggggcttggaccctctgaaaccatggagcgagctgtaccttgaccccttttggcaatggctggagtggctgggacacagggcaccaagtccctagactgcacatagcacggggaccctgggcccaacccacaaaccatttttccctcataggtttctgggtctgtgatgagaggggctgccaagaagatatatgacatgccctggagacatattccccattgtcttggggattaacatttggcttcttgttacttatgcaaatgtctgcagccagcttgaatttttgctcaaaaaatgagtttttcttttctactgcatcttcaggctgcacgttttctgaatttttatgctgtttcccttttaaaacggatgcttttaacagcaaccaagttaccttttgaatgctttgctgcttagaaatttcttctgccaggtaccctaaatcatctctctccagttcaaagttgaatctctagggcaggggcaaaatgccaccagtctctttgctaaaacatgacaagtcacctttactccatttccctacaaattcttcatctccatctgagaccacctcagcctggaccatattgtccattttgctatcaggcttttggtcaaagccattcaaccaatctctaggaagttccaaactttcctacattttcctgtcttcttctgggccctccaaactgttgcaacctctgcctgatactcaatttcaaagtcactcccatattttagggtatcttttctgcatcaccccactctactggtatttattttacaatttacaacaatctatgctcttgaagctatttacatctattttgtctatattgtggaaaaaccataatggtgtgatgctgtgtaattctttccaaatctactttcagcgatgtcaccttcatactaatgcccaggtctcactgtattagttcattttcacgctgctgataaagacataccagagactgggaagaaaaagtgatttaattgtacttacagttccccatgcctggggaggcctcagaatcatggtggaaggtgaaaggcacttcttatatggtggtggctagagaaaatgagaaagatgcaaaagcagaaacccctgataaacccatcagatcttgtgagacttattcactaccatgagaatagtatggaggaaacttatcccaagattcaaattatctcccaccagatccctcccacaacacgtgggaattatgggagtacaattcaagatgagatttgggtggggttgcagaatgaaaccatatcaatatccaagaaaataaaacttggatctttaagtagtatctgcactcctatgttcattgtagcatacatatatatatacacacacacatatatatagatatgatgggatatttctctgctttatttttagccttagaaaaagaaggaaactctataattggcaacaatatgtacgaacccgaaggaacttatgctaagtggaatatgccagacacagaaaacaaatactgcatgattagatgtgaaactgaaatagtcaaactcacagaaggacaaagtggcaacctggtgattgccagggtcagagtggggaggggaaaattgggagatgtttgtcaaagaatacagttttagttatgcagaatgacattccggtgatctaatgtaaagcatggtgactacagtttacaataatgtattatatgcttgaaatttactaagatggaagattgaaggtgttctcaccattccaaaaaaaaatggtaattatgacttcactatatatatataatatatatataaacattacattgtatactttataagatttctatatgtcaattatccctaaataaagctgaaaaaatttaaaaataatcccccgaaatatatgtaatatgaacaataaatataagccacacatgttttttaaaaatttgtcatgtttttaccctgacagcaaatctccaattggatagcctcatttcaagtgctccacaggcacaacgaacaaccgactaccatgtgggccactgcagccctaggaaatacgaatgatgggctctgaaccaatctaagtggaatgactttaaacagaaataatgactcaagttctcgaacttaagtatgcttcagtatcatgtgcagagcttgttaaaacataaatcgctggactccacacccagagactgattcaatagttctgaagtggggatcccaaatttccttttctaataattttccaggtgatgctaatactgcccttcaagagccacgggtgatgaggctttgggaaatcagctttgtaacttttaagtggaaaaagggacatatagttcctaaacatgatataaatctctcctccattacagtaacaattagtgctatagtagaaaagacaggtggtcaaattgtacttaagattacaatttggtcactaaatggaataacacatgtttttttttttttttttttttttttttttagtcttgttaaccaattgcagttgaagatgcaggtatttgaatattatatacacacatatggcacatttaacttagtataatttgtgcattaaagtaaaaatcgagtcatctacatttccattcactgaaggaaacatctaggcataatttcagtaaacaaactggggagtggaacgttataacatgtgcataattcaatttatttgaaattgactgtaagtcctcattaggccttaagtcccttttcaggtgaactatgtctcacatttactgttgcatttctagtttttaatatcttgtatactgtaggtctctaataaatagatgcatgagtagttttatttgtttcatatatttttgggaattcagccttcagttatcctgaaattttaatacagtgttgaagtcccattgtgaggtcaggagagtctgtatgtatgtaaagatagacatctctctaaatcttttgttcctttctgtaataagtattaggaatataatgcacttcagagtaaaagtccagatgctgacaagctacttttaaccttgtgattctggatggtctgattatagagtccatttccaaacttcctttcactacacaggagcctggagatgaattaaaaattacctgatgctctgaattgacatttcacagtgcagtatcataacatattgtaagaagagatgctacacacgaatttttaaacgattaaaaatatatctctactgatgcaagaaaggaactttatgaatgtaacattttctcaaaattggtctcataaatgaagatcaaaaacctttagtcaagtggaagccaatttagagttgttactgtcaagcatctataacttttcaaataaccaaatgctattgctaacatcaggctgtagagtttaaattttcataaattcgactatggagcctacttcattgccggactagaatgacaaatacatgataacctacatgggataattctttaatattgttgtttggggttgacaatgagaatccacccattgactgagttccaactcttttccaggcacttaatttttactcactgaaatacttgtcacagccaccttataaagtaaaaattattatttatgcccattttctatagagtatactgaagctcagggagcttaagtagttttctcagtgacatggatggtaattggtcaaatctgttttgaaaagttcctcagactctgcagcctgcattcctatgactgagctatgctaattagcaagagacagaggcctttggtacacacctttttatcagggaaaagacttcttgtgaataaataaacactaagtcgtatcagtatacaactaaatcggccctaacgcaaggaaatccttaatgatagcatcattatgactctcttaaactatttcactggaaagggaatttttaactctggggctttgagagctggactcagtctgaaggagctgataacatcaaggatttgtgctggcaagggcaagtgcagttgctccactatggagatcataggttggccctacagctctttccttacaaaaaaatctatagaaggtgatttttatggcattatctctcttgcaatagacagtgaggaaatcctcaattgttctatttctacagtttcgtggatcagagtacaattcttgcttccttcgtgtttaggctccggaaagggatttatcatgagagcaaacaaataaaaagaggtagttcagataagacaaaagacaaaagaaatagaagtatgccccagaggagtagatttactatttattctttcctgcttttgacatgagatctataccatgatctttggccctgactacattctggacacacattttatatagtgtttgtgccttaggggaacagtggctactatgcctcctacctgttatcattaatttttctttttcaaaaaaaagtcaatgaaccatatttcttaaaaacattcaccaagctcctcagagaaaatggtttactctgctagaagttatgtctcaagatctcccctctaccccagacaaactaatctccatcattatgacaattctcccatacttacacttgatgacaggtcacaaatttatgaagttgactgagttatggctcaacaatttagtctttattttctttggggagaaaaatgatatgaaatcatataagataaaaattttggagcaataaatcactcaatttgaaataaacatcagtacaggacataaagatgtcatgaaacatttccacccaattgtttaatccaccctcttagtcaagtccagagtatgacattatctttcttttctgctttgtgaagccaagctcatgtttgaaatgagtttaaaaacaaatgaatttcagacttacagaatgttcatcttttagtgttgttattaagaaagttaatgaaaacagtattcttaccctgatgctccaggaaaggcattagatccaaatgagtacataacattccatcattctaatttcgaggttgatatggatagccaatgaaatcctacaattgcaaattgcttcaaagtatttcaccataatgactagactgcaattttgatgggttactgataaacaccaaaaattaataataaggaaatagatgaaatcacttgcattattgtattcaatacaatcttagtaattaatataatttggtcataatatattcatttgtgaacttaccatatgcctattatgcatagagcactgtgtaaagcactggaaatttgtatttgttcaacaaataattactgagtacttctctgaatagaatattactgcagaactggggatataacagtaaaaagtcacacatgaaaaaggcctcccttcatgaaacacattctaatggagaataggcaaagcacatgataaataaattagagtatattggaaagtgttaagtattgaagaggaaaaatataaacaggcaaggacagagaccattttaatgagatggtggtggtgacactttagactgtctgtagggtaggcctctcatgaaaagaagtgacatttgaataaagattgggaagaagccaggaaattatccatgagggtgtgtatggaaagggcacacaagtagatggaaagaagggaaacgagctgagcattttgtggaagagtaaggaggccggggtcctttactggatgctgtgagggggcgagaggtagaagattaagccagagagataaagggaatggctgatatggaaggtcatatgaggattcttgagagtcactggaggattttaggcagagtagagagctgatctgatttgggaggacgactctgactattgtgataagactagaatgcaaaaataaataatttatggtcctaatgaactcacacttcatttgaaaagttgaaaaggatatggattcagcgtagtgagataagttctattagagtacagagggttgatagtaacgggtaagactcctgctcactcctcagcctactccaatctggcttctagccctgtcattacactgagacaattcttgaaaggattctgatgacttttaggttgccaagctccatgtccttcctctagcctcatcttacttgacttttctgcagcaattgtaacattttatatcgccctacttcttgaaatactttcttcccttgttgaccatggctctaccttgtccatatttttttcttgtttctctgggtaggcactcacttttcaggctcactttcctctccctagtaattgggtcttacaatttctgtccatagcagccacattaacaactccaaagggctcactcacaacatagttcaagggactggtggttttttgaagttgtatattgctgtcttgagctgcctaaaatgaataactcatttctgtcttattttttgtctccttgttttgattttctttacataaacaattttaaccatgcatgaggcttcaaataggacttaattgcaagtttatgtttccatccaggattctttgttgtgtaacatactcatattcagttgactgcttgacatctctggttaagtgtcttgaatacgcctcaagtttataatgtcccaaggtgaactcaagggcctccttttgtacagggttcttctccagtgttctctggcttgatggataacactaccacccatgcatcctgctatgcaagacagaaacttaagtattcttctggatgcccctcacttgcgtaccctccaaatccaactcattatttattatccaatctattgatatttttcctcaagccatcaccatagtccatgtgaccatcgtctcctgccctttcttcctccaggagttttttctccttactacagtcacagagattttctaaactgttaattgagtcatgtcaccaatcacctacctgtttagaacactttaatggatttccttttttatcttagagaaacatgatcatagtctttcagtttccaaatatcctaaccattgcctacttccccaagctcctctttctcttaggctttcttcctctttccactttacattcaaactgctactagccttttaaaatgtttttgaacagggctgttacgcatatgagttgctctaccaaagacgtggtgcttctttcttctatttctcatgcaaacatattagcttctactttattctagattttagcatagttattacatcttcttctaaccctgccttcaattcccaggtgaaataaattaccctttataagctctcatagtatatatacctctcctgcagagaacttttcattgagacctagactgctgccaagcacagtgcaggtcctcaaaaataattgctcaatataaggcaagaggattttttggcaggtggtgccatgctcttatttaaccaggatatcagatgataccgtcatttatttacatatttttctgaagcaaataatcactgaactacatcaagtatcgatgactatctggaccttgaaattttaggcaaaaatattacttatagggtttatttgggatatttaatattttaattagatttgaaaatattatggagacaagttaaaacataatgtgcttaggagcttgtttcgaaggttacacaggtgttgcttgtactctaatctcagaactctcaagttctttttttttttgagatggagtcttgctctgtcacccaggctggagtgcagtggtgtgatctcggctcactgaaacctccacctcccgtgttcaagcgattctcctgtctcagcctcctgagtagctgggattacaggcacgtgctaccatgcccagctcttttttgtatttgtagtagagacagggtttcatcatcttggtcaggctggtctcgaactcccgactttgtgatccactcaccgtgacctcccaaagtgctgggattataggcatgagacaccactcccggctagaactaccaagttctaactgtgattctagacaaaaatttccatgcttcactttctccttctacaaagtttcagtgaatgttaaaaagtgaaaatacacaaataaaacatagttaacatacacccgactagctcttcaaaaacattagttctgttttcctgcacttcccacatgttgatagaatttctccttctcaagtgttcttaccagttaaggcagtgcttctttggcttcggatacagcataacgtttttgtctgtaaagatcttctctccctgaatctgataaacttaaatttaatagcatgtacacaaagtgacatagatcaagcaggagaagctagacaggattctccacaccactgttgaggaaaggaaggcataatgccatcacctgcaattagaaaagttgtctgagccattacaaggcattttcaagtctcccataacattttagcacctgtaggaaagcttctctttgtaagcaaaaggttaatagctgtgcttctccagctgtttcacgtgggccagatgtctgagtagcccaaactacttaactgcatattagtggcacataaactgcaggctgccgcttgtcagagagttgttaatttccatagaatgttgcactgaaagtcattactatgtgaattacaacaaatttgttaaggaggttatggtaagcattggtacaaggattagtgcgtttgaaaaaaaaatagaaggttcatcctctacgtgatctgagcgactctctaaggtcttagtcacacacacacatgccccatgctttattttgtgtctgagttttagcttccacaggttgccagtatccatgtattgtgtgtggccaagacatcctatcaaaactgaattgtataaaatgtcaaaaatcttatgaaacttgttagatgtttatgcttattgaggatattttgttatgatagtcaaccataatatggagttctataacttaaaaataacgatcagtgcatgtactgaattcaaactaagcttcagattcagtactcagttttctaagtgtttatctcttgtaggatagggtctgcaaggtgaatctatgggtcacatctcacatatggcccattctcacacacaccatctcatgtaatcctggtaatgtttgcaaaaggccattgtcgtcgtcgtcgtcttcttcttcttcttcttcttcttcttcttcttcttcttcttcttcttcttcttctttcttcttcttcttcttgttcttcttcttcctcttcctctgctttcttcttcttcttcctcttcctcttcttcttcttcttcttctatcttcttcttcctctttttttttctgaaggtggaacagacctagaagctggagttcagtgtttgttggtgacacaggattttaacttcacatttatgacttcacagtcgctgatattagtgttgatttttttgtggattagtatagagtatttttctacaactactgatatcagacaattgccagaatgaggattttgttggcagggctagcaaggaggaaggggagcatttcaaagctgtgtccagctgaatgagactgcctagggcttaagggggcagcctcactcagggaggttctaatgatcagtcccttctccttgaccaatgtgtgtgtgcatttgccccaataaacagtcctggtcattttgaccgaagatatttttgaattagtcttatatgctatctacataaattgatgctatgtaaccactacatacaatggagtactattcagccataaaaaaagaatgagatcttgtcatttgaaacaagataaatgaaactagaggtcattatgttaagtgaaaaacctataattttaaaacagaattgttcttttaatgagacttaaggaatattaattttatttttaaaatttcacagggagaggagagctaaagtaagtgtgtgtgtgtgtgtgtgtgtatgcatacaaacataggtggaagatttgctaatggcagataattatttttccttaattacctcacttagttattttatttaaacattgaaacaattttgctaagtcggtattatctacattttatagaaacatttagaaaatgtgaataccatgcctggggttgaaaatagagcattttgttttgctttctttcaccttcttcactttgcttcttaaaggatataatcttctttttaatcaattgtggtataacatatatattttaattataatagaaatgtttatttcatatgttgtgatcataaaaacttggaaaataaaaatagaaacaaattcaaattacgatttgtagtttcttttttttaacatgtcatatagcttattgcttatttctgaaaaaaaaattgtcttggaaccttccaagttgctgcccactctgaaatgttttactctatacagcctttgtttggggcatgtaactttctttctttttttattattatactttaagttccagggtacatgtgcacaatgtgcaggtttgttacgtgtgtatacatgtgccatgttggtgtgctgcacccattaactcgtcatttacattaggtatatctcctaatgctacccctcccgcctcccccaaccccacaacaggccccggtgtatgatgttcctcttcctgtgtccaagtgttcttattgttcaattcccacctatgagtgagaacatgcagtgtctgctttttttgtccttgccatagtttgctgagaatgatggtttccagcttcatccatgtccctacaaaggtcataaactcatcattttttatggctgcatagtattccatggtgtacatgcgccacattttcttaatccagtctatcattgttggacatttgggttggttccaagtctttgctattgtgaatagtgctgcaataaacatacgtgtgcatgtgtctttatagcagcatgatttataatcctttgggtatatacccagtaatgggatggctgggtcaaacggtatttctaattctagatctttgaggaatcgccacactgtcttccataatggttgaactagttcacagtcccaccaacagtgtaaaagtgttcctatttctccacatcctctccagcacctgtttttttcctgacttgttaatgatcgccattctaacttgtgtgagatgatatctcattgtggttttgatttgtatttctctgtggtataatatatcttaagagtcttgtgtctgtcattacaacttaaataaacttattagaattgtaaacttaagcatttacatgtattttacctagatattgaagtattcagtctttagaaaaaatgataaagagggggaaaacattagtacaaaataagatatactaacaaaagtttgaaacgatacaaatgaggcaatttaccagttacctaagaatgcacaaatgcattaaactaacagggatgtgttttaatagctgtgatattttaagaagtgccgatacagctattccatttcttattcaagtatctctaaggcacttctaggtacacataactgggagaaaattttaaaaaccaaccaaacaaaagaaaacttttcctatctgttccaaacacacatgacagacagattaaaatctattttatgttaaaaatataattgcctttaaaaaggagagaggaaatatctgctaataccaaagacaaagggtaaataaatttaatgcctatgagggggggaagaaggcagattttccacaaagtaacagcgattactttgacaatagattttatcactaaaaataaataaggtcaataaactattatccttaaagtattcagtttagaatcctttatgatagttataccattatactatgtggtgggtgtcagagtgaaggcatttaagaaatataaagactataaaagcttattatccacccatctggaaaggaccactaaggttgtagctgaggaaacaatactgtagtttaaaaaagtaaggttcaaaataaaatcttaacagcaaagtgttgaaacatgctttattagtttttcaatactgtggtaatacaaactaccacacatgtagtaacttaaaattaacccagattttttatcttatagttgtggaggtctaaagtccaaaatccttctcactgggccaaagtccaggtgttggcaggactggcattttgggaataaccttggatagaattctttttcttgcctgtttcagcctctcaattctacttgtaattcttaggtttttgctcctatctccatcttcaaagccagcagtggtgcatcttttaacctccgtgacttctgctttcatggccacatctccttgtctcactcttttgcctccttcttttctgtataagagcctttgggcccatgcacataattcaggacagtctctccattgaaatatccttaatttaatcacattttcaaagtctttttgccatgtaaggtaacacgtttacagtttccacagattagggggactaatccaactttgggggactacttattctgcctaccacacatattgatagagctaaaaaaaagtactatacaaaaaaaaagaacagtgatcctgtttttttttaaaacagagcaagagagaggaactacattagtaatgttagtaaataaacatcaaactaactgtaaagaaaataaaagttaaaataaaagttaaaaaagttattcaaagtcaaagtattaatacactattgagaaaatcaatagagcaaagagttggtcttttgagaaaacaaatatgtttgataaactgctagaaagaataaccaagacaaagcatgtataatgcacaaatcatccatatcacaatacgcatacataaaaagttaataagagattatgaattgttatatatgaatcaatttggaaacttagatgagatggataaaatttcccaaaaactgcaacttagtagaaaatacaccagaagaaatataagttctaaatagtcctatatctatttaaaaaatgaatacctaattaatgaagaaaacttttgtgagattagaacaaacttgaagcccaaaccagttaagacattataagaaaggagaattgctgacctgtctttctcataagcgtagatacaaagaattctggatggactagctatttatttatttccagggatatattaataggatgatacaccaaaaataaattggttttattccaggaacacaaggttggctcaacatttaaaaattgaacaatttaacttatcatagtcgcaaaacaaatgagagaatacatctgattatttcaacatttgcaaaaagttcacttgttgtaatttagtacccactcatgacttgaatgtgtacttagaaggtataaataaatgtatagataaattatgagaactactgagtgaatttagtaagatcattgtactcaagatcgataaagaaaaataatttttgtatgtatattgccacaaagaactataaaatttgaaaatcggatgccatttataataccataatataactctagaaaaaaaactaaaaaacccttaaaaggtattaacaaggagaactacaaaatattactgacagaatgtacaaaagacttaaatatataaagttatattctatgttaagcagtaaaaaactcagcgaaattaagttgtgtttttccctaaattgatccattggtttactacaatcataatttaaatctaagctgcatttttggctgaaaaatttcaaactgaatctaaactatactgggaaatgcaaaagacctaggaaaggcaaaacactcttgaagaagaaggtggacaatttatacttgtgaaggtgttgcatttattatgatactctagtaaggaagacagtgtagaattagtgtaaaaatacacaaatagaacaataaaagaaaaaaaatagactttccaacaaattatgctgtgtcaattaaatattcctatagaaaaaatgaatcttctattttacaccatatgtcgaaatcaattttaggtgaattgtaaatctaatatgaatggcagaacaataaagtcataaaagataatatgtgatcatagttttataatcttggggtaagcaaagttgtttttttcaaaactggacataaacaattctaaccgtaaagaaaattattgatatattgaattatgctaaaaagacattctgctcataaaaatatatgattaagcctgtgagagtcaaaccacaggagagagaagatttctgaatttctagcaataccaagacaaaggcatacaagacaattttaaaactgggcaaatgcactttacaataaatctatcaaaactgctagtaaatgtgacaatgtgcttggcatcattaattattctagaactatgacctgatgctaatgcctgcatattaagagtgaatacaattaaaaacagaagaaaaaaactctttattatcaaaatttctcatatcttactggtgggagtgtaaattggtacagtccctcaaaaatctcttttacagatccactaaagctaaacatttgcgtactgtataacccagcagttccactgtcaggtatatgccccacagaatgttatgcatatgttcacaaaaatgtatacacaggaatcttcataggtgcaatgttcatgtgactgtaagtgtaaacaattcaagtgtttataaacactagaacagataaaaaattttggtatgttcatataatgcaatactataaagcaatgaaaatagacaaagaattgccatatccaacagaataagcagaaatgaatacagacaacatgattccatttatatcaattttatttatttatttttacttattttttcttttatttatttatttttttgagatggagtctcactctatcacccaggctggagcgcagtagtgcaatcttggctcactgcaacctctgccacccaagttcaagcgattctcgggcctcaacctcccgagtagctgggattacaggcacatgccaccacacccggctaatttttgtatttttagtagagatggggtttcaccatattggccaggctggtctcagactcttgacctcaggtgatccacccaacttggcctcctaaagtgctgggattacaggtgtgagccaccacacccagcctcatttatgtccattttaaatgaaattataattaatctatagttctagtaacttatatgtttctttaatttctctttcttatattgacattaataatacccttgatttttattagaacatgcctactttatctttttttaaaataaccttatttacaactgacctatttaatttaggcagcatataactaattatttttggtttggttttatttgatataatctgataatctttttaactcattgagttgagtttaactcatttttattttaattataattataggtatattttgggtcagaagttagaaagtatttctctcttgtgataattagaatttgagcagaacttccatgttgatataatatttcttgatcagagtggtaataaaatttatcgagatgcacatttaatattatgcacgttttgaaacatacataatatgtatgccaataaaatattcaacattttcataaattaaatgccttaatgagataaataatccaagaactgaagaaaccactctaacatacatagataatgtgttggatgtgatattataattctaaataaaataatatcctccccacattataagcaaaaaaaaaaaagataaatttaaaaggaaaatatgaaagaggtcacatcaaaagtattagaagaaataaagaagaatgcatatgtggcatcaaggtaaataatatattatttaggaagacagcaaaagaaaaatcactaaccagccgagtgtggtggctcacgcctgtaatcccagcactttgggaggccgaggtgggtggatcacctgaggtctggagttcgagaccagcctggccaacatggtgaaaccccatctctactaaaaatacataaagtagccgggtgtggtggcgggcgcctgtaatcccagctacttgggaggctgaggcaggagaatcacttgaacccgggaggcagaggttgcagtgggctgagattgcgccattgcactccagcctgggtgacatagtgagaccctgtcaaaaaaaaaaaaaaaagaaaaatcactaaccatagaagaagtacagtgcaatctaacttcattgaaatcacaggcttttttaacaacaacaagatgccataaacatacttaaaggaaataggatcaattaggaaaatatatttaccatgtatataataaggttagaatttttgatagaaatgtaaattagtataaaatttgaaggacaaattttaaatatctattaaaatagaaaatgaacagcaaaaaatatatgtatgcatgtgcatgtatgtgtgcatatatatgtgtgtgtgtgtgtttgtgtttgtgtgtatatatatttatattctttaaatatgctgtacacaggtacaatggaatgtttgttggagcaatatttgtaaacctaaaaatacatatggcctaaatagtcttcaaaactgctaattactataatgttgaatacaatttaaattcctatatatcaggtgaaaagaagaatgtgtctcaatagttacataggaatagacattacagtacattttgaatgtggcgtaatatgtctatagtgatcttatttatataaattaaaaataatcatgctcaaaaagttatacagatggtccctgacttaagatggttccacctacagtttttcaactttacaacgatgcaagaggaggatctgtatttgtaaataggttgtactaaatttaaacgaatgctatacagccatccctgggaatctgccaggtattggtttcagagcacccctaccctataccaaaatctatggatgctcaagtttcttatataaaatggtgcagtatttgcatataacctatgcacatcctcctgtatactttattttttgtagagaaaaggtcttgctatgtcacccaggttggtcttgaactcctggcctcaagtgaccctcctgctttggtttcccaaagtgataagattacaggcatgagccaccattccccaccttgtacactttaaatcatctctagattatttgtaatacctaatacaatgtgaatgcaatgttgctacactgtatttttaaaatttgtatttttaattgttgtaatgctattttttattattttttccgaaactttcaatctgctgttggttgactttgggaatgtggaacccattgatacagaaggccaactgtgtgtatatagatatatatacacacacacatacatatatatatatgtgtttctcagaaatgactctgtgtgtgtgtgtgtgtgtgtgtgtgtgtgtgtaaaaagctatgaaatgcagtcataatgcaggttgcttctgacagggctgaacagtgggaaaggaacaagggagaagaatgaaacaggaatgacacagagtacgatgctacataaaaacttaaattagcttttttttttcctaatttgaaaatatgaagcaaatatttaagaattttgaatgtctatacttcttgaaggcatgttttaacatgtgataatgtagtttttacttataatttaattcaataattatcagagggatttttttctgaaataaatagggaaatttaggtagctgtgagcattgaagaggttatttggagagaagatatgaaaaaatcaactcctggacctgggtaaggaaagataacttgtgctgaaacaaaagtacagagagcgcagatacacaccccccaagatttcagcttaatcttacttatatcatcatcgagttgggagaaggagaagaaaaagaggggaggcctgtgacaataattcttttattcatatatttactcatcaaaaaatacttattgagaaagtgctagataccctgtcctaggtattatcaatttactcatgaaagcttcattctgtctcaaggaattgtgatgattcctgtaataacagcaagtgcaaagtgctaccaaatgatagaagaaatagtctatttgtggatattgaagaagaccgcacattccagagggctgttgaaaagcacagatggaaagagtggaaaaaaactgcagactaccccatacaaagacacacagtcattaaaggacagggacatttggtcagtgaaaccatcttgttctgctggaacatagacagtccttgtgaaaaccaagaaccagcagaattgaggctgaaaatcaggtgaggtcttgttgccaactaacccttcatactgttcccagttttatgggtgatgggaagccactggtgcatttccaaactggaaatgacacaaggaattgctgttttcgaaagagaatccaatcagctgtgcaaaggaagttctcaggagagaccagatatagaaagacaaatctgactaatacatttttttttcttaaaaaagagactagaaaggtaaaggtaagtggatggataggaagagagaatttatgaacaaaagtagtatggtatggtgagatttgatggctatttggttatgaggaggcagggagaataaacaagtgataatgactacattttttagttttggaaaagcacttgtgagtcattcagggatgttcagttggcagatggaaatagaaaaaccaattatgagtcttctgctcatacattttaggaagtctgcattgaagctagttctccttttactcagtgatcccatttgagctaataagcttcataaccactactcacttcataaccactactcacttcatgtcatggctctggcctgtgaaagggaggtttacctaatgaagtaaaagttattcttctaaagtatagtcactgttgatacatttctcaggaacattctttttcttttgacagcatgctatgaaataaaaattgcgtgcagacctggaggaatattaacatatgaagacattgggggaaggttattgattgatttactgaatggtctgattcaaatgaactcctaatatatatagaccatctcagaattaatcaccttctctactcttagagtgttccttatcattcaggtagcaatcatttgaacacccatcatttttaaaaaatgaaaaagaaaactgtaactaccttgacaactggaagcatgattttaagtagctgaaggagttactggcttaagttagaaacaaaccagattggaaactaggtataaagtaattaatttcttccattttgagaagttggaaggtctcactgagcttttgttggttacttattcatattgagaaattgattatttcttttgcctaaagtcaaagagctctgaagagacctagtcaagatttggatgttttgaatacagtcacaattatggtctcagaaatactttaaaacacattcatcagtcatgctcttattcagaatcagggcacaaattttaaacaataaaatccatgtgaacttaaaaatatgccttcgagttattgaacatctaattaaattgcttatttctcattatgccttctctaacaataaatgattttcattcctgaatcccaatgggattttcctggtccacttgtaagttgtttatttagatacacaatgtgaatctatatgttgatttattttgtaatggttcacaggactgggctactttcctctgagtgagggtaaaattaatcagtaggaaatgaatattgtcagtgtcaatgattataagaggaaattatatgtgggagcaagagagaatgaagcagattatttgtggttaggagttaattcagagggatccatgcataatctccatctccgccaatttggctgttttactcctgttgccatcatgccagcatgggatgctcaatatcagaggctggctgacatcaactggatgaaaccatttgttgattgatggtttattgtttcttccatggtgaatgattgctactgggaaataatatgggatacaaagatcttcaaacattatgctcacttccatatatctctctccattcagatctccttttccccagtctctaatctttctccctgcaggcacctgtcccattgtccagtccgttggtcatggctcatgaattcacacataattctaatcccagactatttctcttcccacacacaatagatgaccagttttactgtttgaagctctgcccattgggagcaattttctttaccactctattttaaggtcactcctgagaaaggaggtaatgcaactacagactatttttaccttgcatccacatatctaagcaaattatccatgagctaagctaggggtatttcctcctccttcatttggttgtggatctctcatagggccactggagtgatctcaagagagttggcactggtgcagcagtgaggagtgtcacagggctctgagatgcttgctcatgcagcttgcttgtgccctcttgtcttgcttatgcttagccattgatgtgactacatacattcatctgacaccatgtgccatataagcgatgcttaatcttaggactcaatctggacagaacccactcatggcagggctgcttacatcatagtctagatctctgaagagcccttttctgttctgggtcaccctcaaatctgccagccttctgcacgattaaattataggccatagcaatattctcgagtgtagaaaacgctgtttccagatcctgaagaagtctaccaggtagaatgattccttctctgtggtggtaggtgagagatgcaataatttgctttttacattggctaagatgtcccatcatatacctaacctatgtgtcctaaaaattataatgagatgagaggcccttgaatcttagcaggattcatctccttcactcaaaagtgcacacatttactaaggtttctgacatgtcattgaaattgcctttcaaaaattgtaacagttagataaatctaacatagctgactctgtcttgtttctaacctcgcaagcaaactgcctttgcccatccgtacatgtaggacaagctaactatgggaagaatttagtttatagtttaaagcaagaatgatagtagtctcttcccaaaactaatctcccacttattcaggtactgaagtcgctccttgtaaagctaataaaaggccataattttagaattacagtaagatcctgaattctgctaatgctaggcatagttaaataataactagtcattgtctcctaatagatttactgctcaggagtcatgtagccagaggtcacaaaatttgtaacttccctaattgccccgagagacagcattgctattgcaaaacctgactggtgtttgcaatattttttagagtttgcattctttgggccaacagatgccaaccaggctcatgacccatatcaaaaaactgactcaactgctcctgtgacaacccagaaactgactcagtgcacgaaggcaattttgatgcccgtatgatttcatccccaaccaagcagcaaatcaaattccatagccccttgcccaccaaactgtccttaaaaaaaacctcacctccaagttcttagggaggcagatttgagaattatctcccattctcctcacttggctggccctgtgattatggaactctgggctgcaacacctgctatgctcaatgtattggctgttttggaaacagtgggcaagaagaacctgtcaggctgttatgttcccagacagaactggggtccagctgcttgttctcatggttcaatcataagatgcaaacagactgggcaagaagggagtttctgcaaccagttacagggagaaaaccagaataactcaacagaccaactcaaagttacaagtttttctccagtgcttataatacattcaaaccatatgcctacgtgtgggaaagcacctacaaactgaagtgtttcactctgtctaatctttaactagggttcagatctggaaattacttcagagcctaggaacaattatgtaatctaaagtgggtcttggtacaaggtgtgcaagaatgcctccttttattaattaaactctaatgtctgagaaagcccaggtggggtcttaatggacttgtttttacattctaacccttgtactaaggcaccagtttctccagttctttaatgcttaagttatacactcatcagatttacactaaggtggtggtgaaggatgactgccctggttgctaatggagacctggcctgccacaattacactagttatttcttactcattcctcagttagcatcatatcattgatggagtggatcatgtgatgttgagtgagatgcatagataatctagatttccttggactatattttaacagaggttgggggcagttaacataattgtgggacaaaacttgaaacatttgctgtcgttcctgccttgtgaatgtgaattttttcagaactgctttttctgctaagaatagaaaagagtgtattcaataaatcaatggccaattataggtaccttagaccaagctaatgtgcttttgcaaggattccatatttggcatggtggctgcaattgtggctactattactttgtactttgtagtggcagcttaatatcttccgttgggatctgtttggttactgcaggaatcaaactggtaaatcatggtgtttgttgggaccaccagcctatgtcctttagatcctgaaggtgcttctattaatactttctgccatccatcccctgagagtcaccagctgcccaatgcaatattgttttagaaataccatctagataatgtaactctgtgtcccatcatgcaaggcttggtaatatatttacttttgtgtttacttttctttctaatccattatctatttctcagccaatatgagctttttaaaacacaaatgagattatttaatttgtctgctaaaaatccctcaatggctttctactgcccttccaataaaatcagaatctctgattaaaaactaacaattcttatgatttttgaccctgactagatttttggccttaaaatacatgatcgtccacctctagcacaagcctccagtcataggattttttgcatcttaaacacagcacctttcccatcagggcatttggacttgcctttccctccgctaagagtgcttttcccagcacactgaaggagggcttgcacttcatctttttattttcaactcaaataatacatcttcatgaggtcttacctgaccacatagtccctgaaaggttcaccgaaaagtcactggcatgaggcacattgattaataggagaagagacataaacatttatttaacttctatacgtgggagccttaagaatgaagaccagcttcccaatgagttacagaaatgtatataccatcttgaggccacagtaaagaatacagactcagaacatggccagaaactggttatattggtaaatcaggcttagtgaaaagacaggttatgagagagagaaagaagcttgactagcaaatgtgaccttgttatgtagatgaagcttcccttagaatagagggtaaatgtttctcttcatactttaaaggtgtcagactctccagtttcttcaggatctggaaaagcacaggaaagggaggcagcctggctgcattgaaggaaattctctacagatccaaattttccccacaaaagacagctttgcagggccacttttgtttgctagccaagtggcagccatttcaaaatatgtcaaaaaatacattttgagggtaagatcattaaatttcctttaccaccatgattaaggtagcagctccatttatatttccttcagctagtttttctgcgtatccacttgcctgtttgtgtgtccacactgactagaatatgagggcagcagcaggaacaacagcaggacctaggagtggttgtgacttcttttgatctcaaggaggttcttctaaatgttgattctactggaatatgacataccagtagacagatggacagacatctaatctgcatagatgggatttggagttattgtaatctcaaattaggaagtcagagaggttctttatatcctaatgggtgaagctaggtatacaagtttcatagatatttttgtacgtatcaactttggtttaaaattaatctagtacttctatttttaaataatgataaatgtatgacatatagacatgcacttgccacccacaattaatgaatgttatattttttccaaactttttaatgaagccctttattccatatatatgaataaagggcttcattaaaatatatatatataaaattttatatatataatatatatattttttaaagaaaataattccaggtatagttagagcaaatctccctcatgtcttacaactaattttctacttccccacgcataatggatctcacagcattttgttgcattcctatacacattcaaatttttaaaaaatatatatatatccataatttcttgtattgttttgtttaataatttatataaatgcagttacatcaaatatattatgctccaacttgctcatcttaaataatagctttatattctgagagaaatccacgctgagcatgtgactctatttaaatcttacctgttgaaagggcccttatgcgcagagacagactgtccccctgtaggtcctaagaggagttcagtaactgccctgatctctgaactcttggcaggtctcccagactcccagttcttgtcaggacgccctcctcccaattgttctgccctgaacggattgtgttttctccactatctgccctgcaaccaagcaagcgttatctccccatttttatcatcacagaaaggccagccttccaggacatctctaatccttcaattctaaccccacatgcattcaatacatcaacgtttctcaatatttaatgtgcatattaactacttattttttttttttttgagtctcactctgtcacccaggctggagtacagtggtgtgatcttggctcactgcaacctccgcctcccgggttcaagttattctcctgcctcaacctcccgagtagctgggatcacaggcgtgtgccaccatgcccggctgatttttgtatttttagtagagacggggtttcaccatgttggccaggctggtctctaactcctgagctcaggtgatctgcccgcctcggccttccaaacttctgggattacaggcataagccaccacacctggccttgaactactttttgtcacatgaccttctccctcttcaagtccagcaacagagaatgctcctcactttagtttcctcttgtgcttaaagtctctgtcaacaggacaaacttgtccatattgacgactcacctgattgcgtcagggtcgctagaggaggatttcattatcttaagattaacttgggaggctgaggcaggagaatcgcttgaacccgggaggtggaggttgcagtgaactgagatcgggccactgcactttagcctgggagacagagggagactctgtctcaagaaaaaaaaaaaaaaagaataactcggtgagaggtggccaagatggcttattagaagcagctagtgtgtgtggctctcacagagaggacgggaaagggcgagtaaatacagcacttcaactgaaacatcaatctactcgcattgggaataatcaagggaacaactcaacccacagagaatggagaagagcaaggcaggacactggaccacctgggagtgacacagagcaagaagaacctcccctgcccagggaagcagtgagtggatgtgtgaccctgggaagccatgcttttctggtgagtctttgcagccctccagtcaggagatccccttgtgaacccactccaccagggccttcagtgtgacacacagagctgccgtggagtctcggcaaagcagccactcaggcatatgcaaacagcaggaagccttagatgctcaggctttctgggcttctgggcaaaagtagctgcaactctagcaaagcaggagggtagatccctgtacatatccctaggaaaggggctgaatccagaaggcctagcagtgacagtctgcatgttccacttccacgggaccttgcaggataagacccattggattggaattccaaccagtcaccagtagcagcgttacacctccctgagacagagcttccaagaggaggggcaggccaccatttttgctatgtgggtgacttagtcattccaggcttcaagctttggagagttcaagccaactaggggtggaaaggatcccacagcacagcacagctgctcttaaaagtgtggccacattgcttgtttaagcaagtccaagatcccgttactcctcacagggtgggaccttgcaactggggtctccagccaccttctacaggtgtatttgggctggcaacgggcttgtaacttcctgggaaggagcttccagagtgaggggcaggccaccatctttgccattttgcagccttcactggtggtaatctccaggtaatggaaaatccaaggcaactagggattggagctgacctgcagcatactacagcaaccctataaaaaagatgtcagactgttacgtgggtgcccattcccatatcttctcaccaggtgcatcctccaggcctgagcctccagccaccctctgccagagctatcaactccctaggacagtgccatcaggagcaagtgaaatcctctctgtcactgcctctgcagtcgaactgcctttcctagtctcagactgatgaaggattgaagaccataagtgccttatgcacacctccaacaaggtgcagtcaacccaaggagaggaggccagttcatcacccacgggtcccccacataccccactgctcattaccagactgggaacccctggcttgggcccacagcacaggccctccatccggggctgattgcactgagtgattgctgaccttaaatctctctggggtggagttcccaggagaaaagcaaaagactcgctgccataaccagtactaagttctcttcctttactgactctaagttgggaaggaacataaacactgagattgccacagagtggcagtggacagcccaggcatgccaagctggtatctacagcagcactcaagggggagaggaacccatactttcaggacattgagaggcaacatggctacaactgaaggaaacagagcaagagtctatcagctggcaagtatgcctgagtgacacctactaaatcacaccccaaagcttcaacaccaaaaataccttgctaacacgcccccctctgaaaccagagacaaggagtcagcttcaaataaagaccccgcacaaagcctttacccagtgagaatatccggcaaagtctattgactgtactcaatctatactgcagttaaaggaacacacacatgcagagatgagaaagaaccaatgcaagaactctggtaacccaaatggccagtattctatgtcctccaaatgaccacaccatttctccaacaagagttcttaactaggctgaactggttgaaatgacagaaatagaattcagaatatggataggaacaaagctcaatgaaattcaggaggatggcagaagccaatgtaaggaaactaagaatcacaataaagtgatgcaggagctaaaggatgaaatagcgggtggaaaaacaaacaaacacaacacccaatgggtctgtcagagctgaataactcaatacaagaatttcacaatgcaatcaagtattaacagcagaataaaccaagctgaggaaagaatctcagaacttgaagacttgctctctgaaataagacagacaaaaataaagaaaaagtttataaaatgtgataaacaaaacctttcagaagtatggcattatgtaaagaggccaagtctatgagtcattggcatacttaaaagggatggggagaaagtaaacaacttggaaaacatatttcagggtatcatccacgaaaactttccctatcttgccagagtccaacagtcaaattcaggaaatacagagaatgcctgtaagattctacatgagaaggtcatcccaaggtacataattgtcagattttccaaggtcaaaatgaaagaaagaatgttaaaggaaactagagagaaaggtcagtttacctaaaaagagaaacccatcagcctaatagtagatctataagctgaaactttgtaagccaaaagagattgggaacctatgttaaacattctaaaaaaaaaaaaaaaaaaaaaattcaaccagaaattttatatccagctaaattaagctttctacgtgaaaaagaaataaggtctttttcagataagcaaatattgaggaagttcattacctccagacctgccttaaaagagatcttgaaaggcggaaaggagcactaaatatagaaaggaaagaccactagcagctaacacaaaaccactgaaacacacagatcagtgtcactataaagcaaccacacaaacaaaccaatacaataaccagctaacaacataatgacacaattaaacccacacacatcagtactaaccttgaatttaaacaagctaaattccttcacttaaaaggcacagagtgacaagctgtataaaaaagcaagacccaatggtatactgtcttcaagagacccgtctcacatgcaatgacacccataggctcaaaataaagggatggagaaaaatctaccaagcaactggaaaacagaaaaaaaagcagcagtgagaatccatatttcagacagaacagatacagatttcaaaccaaaaaaaagcgggcattacataatggtaaagggttcaaatcaagaagaaaacctaactatcctaaatatacatacacccaacacaggaacaccaagattcataatgaagcaagttcttagagatgtacaaagagacataaacctccatacaacaatagtgggagactttgacactccactgacagtactaaatcatcaacatagaaaattaacaagatattcagggcctaaacttagcactggatcaaatggatctgattgacatctacagaactgcaccctaaaacaacagaatattcattcttctcattgccacatggcacatactctaaaattgaccacacaaacgaacacaaaacaatcctcagcaaatgcaaaataatcaaaatcataccaagcacattcttggaccacagcacaataaaaatagaagtcaatactaagaaatctctcaaaaccatgcaattacacgcaaattaaacaacattctcctgaatgactttgcgtaaatattgaaatcaaggcagaaatcaagaaattctttgaaactaatagaacaagggtacaacatgctagaatttcggggacacagtgaaggtggtgttaagagggaaatttatagcactaagttcccacatcaaaaagttagaaaaatctcagattaacaacctaacaccataactgaaagaattacagaagcaagagcaaatcatgctagcagaagacaagaaataaccaaaatcagaactgaactgaagaaaatcaagacatgaaaaaccactcaaaagatcaacaaattcaggagttagtttttggaaaaaattaataagatagataggctgctagctagaagaaaaaaagaagaaaagagagaagatgcaaaaaaaaatacaattagaaataatgaagagaatattaccactgatctcacagaaataaaaataaccatcagaaactactacgtgcacttctatgcacacaaactagaaaacctagaggagatggatgaatttctggagacacaccatcacaagactgaaccagaagaaattgattcagagaacagaccaataatgaactccaaaaataaatgagtaataaatagcctaccaaccaaaaaaagaaaagtccagtatctgatggattcatattcatagccaaattctaccagatatacaaagaagagctgtatcatttgcacagaaactattccaaaaatttgaagaggagggattcctccctaactaattctatgaagccgatatcattctgatacaaaacctggcagagacacaagaaaaaaagaaaacttcaggccaatatgttcaatgaacattgatgcaaaaattctcaacaaaagacctgcaaaccaaatccagcagcacatccaatagctaatccactacgatcaagtaggcttcatcaccagaatgcaaagttggttcaacatacaaaaatcaattaatttgattcatcatataaacagaactaaagacaaaaaccacatgatatctcaatagatgcaaaaaaggcttttgataaaattcaaaactttttcatattaaaaaccctcaataaactaggaattgaaggtgcattagtcagggttctctagaggtacggaactaataggagaggagtatatatgaaggggagtttattaaagagcattgacttacactatcacaaggtgaaggcctacaataggctgtctgcaagctgcaagcaaggaagccagtctgagtaccaaatgtaaaaggtagggaagtcaacagtgctgccttcagtctgtgacttaaggcctgagagcctctggcaaatcactggtgtaagtccatgggtccaaaagctgaagaacttggagtttgatgttcaacagcaggaagcatccagcacaggaccaagatgaaagccaggagactcagcaagtctagtcctttcacattctttcacctgcttttttttctagccatgctggcatctcattagatgatacccacccaaattgagggtaggtcttcctctaccagtcccctgactcaaaatgttaatctcctttgacaacgccttcacagacacacccaggaacaatactttgaatcttttaatccaatcaagttgacattcaatattaaccatcacagaatgatatacctcaaaatgataagagccatatatgacaaacccacagtcaacattataatagattggcaaatcctggaagcattccatcgaaaaccagcacaagacaagtatgccttctctcactactcctattcaacatattattgtaaattctagccagagcaatcaggcaagagaaagaaataaagaacattcaaataggaagagaagaagtcaaactatctggttgcagatgacataattctatatctagaaaaccacatagtcttggcccaaaagctccttcagctgataaacaatctcagcaaagtttcaagaagcaaaatcaatggacaaaaaatcactagcattcctatacaccaacaacagccaagccaagaaccaaattagaaaggcgatctcattcacaaatgccaccgaaagaataaaatatctaggaatagagctatccaagaagataaaatatctctacaataaaaattataaaacactgcccaaataaatcagagaagatataaacaaatagaaacacatcccatgctcatggatatgaagtaataatatcattaaaatggccatactgccaaaagcaatttacagattaaatgatattcctatcaaactactgatgaaattcttcacagacttagaaaaaactattttaaaatccacagatcctaaaaagagctcaaatagccaagcaatcccgagcaaaaagaaaaaagctggaggcataatgttacccaaattcaatctatgctataggggtacagtagccaaaacagcatgatactgctgttacagaaacaggcacatagactaagggaacagaatacagagcccccaaattaaggccacacacctgtgaccatctgatctttgacagagatgacaaaaaataaggattggggaaaagactccctatttaataaatggtgctgggataactggctagccatatacagaagattgaagctgaaccccttccttaaaccatatgcaaaaatcgactcaaggtggattaaagacctcaatgtaaaactccaaactgtaaaaatcctaaaagacaacctagccaacaccatcatggacacagaaatgggcaaagatttcatgacaaggacaccaaaagcaattgcaacaaaagcagaaattgacaaatgagatcgaattaagcttaagaacttctgcacagcaaaagaaactatcaacaatataaacagatagtctacagaatgggaaaaatatttgcaaactatgcatctgacaaaggtctaatacccagaatctataatgtacataaacaaatttacaaaagaaaaaaacacattaaaaagtgagcaaaggacatgaacagacacttttcaaaagaagacatacatgcagccagcaaacaggaaaatttcagtattactgattgttagagaaatgcaaatcaaaaccacaatgagatgccatctcacaccattcagaatggtgattattaaaaagtcaaaaacaagagattctggcgaggttgcagagaaaaaggcacacttttacactgttggtggaagtataaattagttcaacagttgcggaaagcagtgtggtaattcctaaaatacctaaaaacagaaatacttttcgacccagcaatcccattacagggtatatacccaaaggaacataagtttttctatgttcctacccatatatgactgtgggtttgtcatatatggctcttatcattttgaggtatatcattctgtgatggttaatattgaatgtcaaattgattggattaaaagattcaaagtattgttcctgggtgtgtctgtgaaggcgttgtcaaaggagattaacattttgagtcaggggactggtagaggaaacatgcacacatatgtttattgcaacactattcacaatagcaaggacatggaatcaacctaaatgcccatcaatggtagagtgaattttaaaaatgcggtgcatgtgcatgatggaatactatgcagacataaaaaacaataagattatgtcttttacattgttgatggaagtgtaaattagttcgattgtggaaagcagcatggattcctaaaagagctaaagtacagaacaaccatttgacccagcaatcccattactggaaatatactcagaagcatataaattattctattgtaaagaacacgcgtgcaaatgttcattgcagcactattcaggagagcaaagatatgaaatcaacctatgcccatcaatgacagattggataaagaaaatgtggtacatatacactatagaacagtagacagccataaaaaacaagatcatgtcttttgcaggaacatggaaggagctgaaggcctattcttagcaatctaatgcaagaacagaaaaccaaataccacattatcacttacaagtgggagctaaattataaaatcctatgaacccaaaaatgaaacaacagacagtagggtcttcttgagggtggcggctaggaggctagagaggagcagcaaaggtaagtattgggtactgggcttaatacctggatgattaaataatctgtaaaacaaatgcctgtaacatgagtttacctccataacaaagcttcacatgtaccccgaaccaaaaataaaagtttttaaaaaagaataactcatttgtggtctaattatatcttcaaaatcccttcacaacaacacctagattagtgtttgactgaataactgggagaaggtgtgtgtatagcaagtgctgggaattacggggtctatcttagaattttgctagcacaccttctgagtcaaaggtgggttcccattagagtagaaatcagcactgcttctgaaatttccccgaattgaaactatgggcgaactatacaagaaagatcttggaggacttacttttaccctatcgttcactaaatgtttattgtccacattatatttgctgagcacgattctattcatgaaagacatggtgctgaataaggtgatcacattcaagaaattcagagagtttagtctttagtgaataagaggagtgtaggaatatagagtctaatagagtacatgttttaaagttacttacaaatttatctcaattatatatatatgtgtgtatacatataattgagtatatatatatatatatatatatatatatatatatatatatactcagtgataagtgctatgaagggaaacctgcgtacagaaaatgatgatgtagtgggaagtattttaaatgagctattgacagaaggcctctctgaggaagtaatatcagagcctaaacctttaagaagtgaaggagtaaaccagaaattgcttccagtacctctgtaaaagcccaaagctgtaataagctcaggcttcataaagataacaaggaggctgatgcagatacaattaaaatgagtgaaagatgagtagtgtaaaatgaggtaggaagaaggagactaaagccagataatgtaaaaacctgctactaatagacgtcagtcattgtccaagcaaaataaaggtattttcaacattcaaaaataacaagagatcatggtcgctaacaaagaggctgatgcagacagaattaaattgaatgaaagatgagtagcgtaaaatgaggtaggagaaggagatcatggcagatgggaggcaggatagatcgcagctccaactcggatggacagagcaatgggcagaggcctacatcgtgaattttagctccgagattgattgcaagaatgaaccagaaatccagagaggacccacagaccctctgaaggaaggggacttctcttgcagcacccaggagacacccaaatactgtgagtgtcccagctgcagaagtggggaaatgagatcctcctctcccaaacacacacccccactggggaaactgaaggtttgcttgttggagaagtttctgaccttaactggagctgagtcaatctagagagtccagtgaaatacaggggaaaaagaagcagcaggaaaggccctgggagctcactgggttcccaggcagtccattcctgcctggcaccacagggatccttgggagggtggccagaggggcagaggaaaatgccacaggaagaaggaagtctctggctaaattttgaaacagttctagctaggcaagaggcctcttggccagaattccagggagggtgtaaatctggtgtgcagactctataggcaggggaagaaccaagaccttttctttcacagctgggaggtgggtggcctggggcaagttctcaagccctgctctccaactgcctggaaacagatttggggctgttcagatgtgtatggtgggagtaagaccgtcccttcaggttgcgtgggagctgggtaaggcctgtgactgctggctttcccccacttccctgacaacctgcatgactcagcagagacagccataatcctcctaggtacataactctattaacctgggaatatcacccccatcctccacagcagccacagcaagacctgcccaaggagagtctgagctcaggcacgcctagccacaccctcagccgcacccccgcctgatggtccttccccaaccaccctggtagaggaggacaaagggcatagtcttgggagttctagggccttgcccactgctggttcctctccatactaccacagctgatgctccctggaaagaaccacctcctggtaggaggtcaaccagcacaaaaatagagcattaaatcaccaaagctaagaaccctcacagagtccatttcacccccctggcacctccagtggaacaggtgctggtatccatggctaagagacccatagatggttcacattacagggctctgtgcagacaacccccagtaccagttcggagctgggtagacttgctgaatggctagacccaaaagagagataacaatcaccggagctcagctcacagaaagtgacagtaataggaaaatggggagagtacaacatcaagagaacaccctgtgggacaaaagaatctgaacaacagcctccagccctagaccttccctctgacacaggctacccgaatgagaaggaaccagaaaactaactctagtaatatgacaaaacaaggctttttaacacccttcaaaaattatactagttcaccagcaatggatccaaaccaagaagaaatccctgatttacctgaaaaagaattcaggaggatagtcattaggctaatcagggaggcaccagagaaaggctaagcccaatgcaaggaaatccaaaaactgatacaagaagtgaagggagaaatactgaaggaaatagataacataaagaaaaaaaatcaaaacttcaggaaacattagacacatttatggaattgcaaaatgctggaaagtctcaacaatagaactgaacaagtagaagaaagaaattcagagcttaaagacaagatcttcaaattaacccaatgcaacaaagacaaagagaaaagaataagaaaatatgaacaaagcctccaagaagtctaggattatgttaaatgaccaatcttaagaataattgatcttcctgaagaagaagagaattcctaaagcttggaaaacacatttaggggaataattgagtaaaacttccccagccttgctagagacctagacatccaaacacaagaagcacaaagaacgtgttggaaattcattgcaaaaagatcattgcctaggcacattgtcatcagattatctaaaggctttacatgcatatggacaccaaaagcaagcaggggtagctattcttatatcagacaaaacaaactttaaagcaacagcagttaaagagacaaagagggacattatacagtggcaaaaggccttgtccaacaggaagatatcacaatcctaaacacatatgcacctaactctggagctcccaaatttataaaacaattactaacggacaagaaatgagatagacagcaacacaataatagtggggtacttcaatactccactgacagcactagacatgtcatcaagacagaaagtcaacaaagaaacaatggatttaaactataccttggaataaatgaacttaacagatagatacagaatatttcatccaacaaccacagactacacattctattcaacagcacatggaactttctttaagatagactattgataggccataaaacaagcctcaatgaatttaagaaaattgaaattatttcaagcactctctcagaccacagtggaataaaactgaaaatcaactctaaaaggaaccttcaaaaccatgcaaatatggggaaataaataacctgctactgaaagaacgttgggtcaaaaacaaagtcacgatgaaaattaaaaaaattcttcaaactgaacaaaaatagtgacacagccaatcaaaatctctgggatacagcaagggtggtgctacgaggaaagttcatagccctaaacgcctacatcaaaaagactgaaagagcacaaactgacattccaaggtcacacctcaaggaattagagaaacaagaacaaaccaaatcaaaactcagcagaagaaaggaaataaacaagatcagagcagaactaaatgaaattgaaatagaaaaccactactaaaaaaaaaaaaaaaaagaaaagaaacaaaaagctggttcttttaaaagatgaataaaattggaaggacattaccaagattaaccaagaaaagaagagagacaacccaaataacctcattaagaaacaaaatgagagatattacaagggagtgacaccactgaaatactatgaacataaactagaagagatgagtaaattcctagaaagacacaacccacctagtttaaatcaggaacaattagatatcctgaacagaccaataacaagcattgagattagaatggtaattaaaaaattatggtaaataaaaaattaccaacaaaagaagtccaggaccagaaggattcacagcagaattctagcagacattcaaagaaaaattggtaccaatatttttgaaactattccacaaggtagagaaagaaggaaccctcgctaattcattccatgaagccaacattaccccaataccaaaaccaggaaatgacataaccaaaaaggaaaactacagaccgatatccttgatgaacgtagatgttaaaatccttaaccaaatactagctaaccaaatccaacaacatatcaaaaagataataggtttcataggtaaaagccctatttatatttagggtaaagagggacacggagactatgacatcccttcccagtgtaagagttgcagtaacaaagtgtttctcagtggaggataattcttctcagcagaacattgtcagcttctggagggccagtggcatggcagcagggctaagaagctggagtgaaagcactagatactctacttcctgagcagtggtagactattccctccagaatttcagaaaaaacaaaaaatagggacactttgaggagaaagctaatttctgataacagcatcatagacttacactgacgtagttgagttacaaatgtaaaatgattggcaaaatgtttagcacacaggatgcaacatgtggtactttccttccctctcttttacagtgaaattttcatctaaataagtaagtaaatagattagtggtctccactttggctcctgtgttcagctacaatttctatttagaataggtagacacttttatctgattggtgtaataacttggctaaagctgtggtgtgttggtcatgcagaatagattatccaggatgccgaaggaatggagctttgtatttggggctttgctgactgcctgattattctacagaccaatgaagagtctctgcatccacagctattacactgcctcctgaagaggaggccaaatatcttataaattacaagattcaaaatattattcaaaataatcccacttgtcttcaaatacacatttcctccaaaaattaaaacacacagaaagaaaatgcaaaactccacaaaatttaagaaacactccaggccattatttcaacttcgccgtgaacaattcagggaaatgacaacccaggtggtattttccatttgactaacttatgttttagtacttggcacttgtgtgtctactcccataacaagcaactatgtggtgattaaaaattaaatgttttgccttgtttgaagagctgctgttcagagtattgcattggaaagcacttacctgaaaggagagcttatgttcggttagtggtggagagcagagtgatttccatttgctctgtgcatgtcactggagaggttctaaactgtaaatgctcactgtccatttatggggtttatgtatgcaatttctgcagaaatcgtctttgtaaatgggaatgaaaattatccttgcacttattccacagccttttctcatctccagcaagtgaaaatgagcctttgggtctcaaaatatctcctgtgtgtttgattttgttgggcagatttgaaatgatcctccagctccaaagttggtaaaaacagaatggttttcttcttattaactgagcaactgatatccttaaaaatgatgtctgtatatttcttattatatgacacaaattccagggaaagaccacgggaattgtagtcaggcataacaaccttttttctctctctgctgtttactggctggataatacagggtaaattatttaaattctctgaacctaaattttctcatatataaagtgaaattgaaaatatttttcccaaatttctgcttccagaaaatgtggtccactaacctaaaacttgagagcatggtagtgtatataaaacaaaattctaagcctgacaaccaactgattggaccctttctctcagtcaagagcgttccaaaattaacctgaaaaatcagttaatgtcataatgtgaagggggaatcagacacgccttatactctccatcctttggaattcaagcacagctgaccagtatcagcattaaaacagagatcttaagactaacaaaacagactatttgtagcaataagatacacaattccaaccgaactctagtatagcatcatacgacagatagcaggccctgaaagaaatcaaagtatttcaccccaaaatatatcttactaagtcttttcaggaaagtcaggcaccttttaaggtctgataaaaagacatttaccatttaccatccattgtctctgaagtcttctccctagaggcttcacctgtataacaagagccttggtttccacaaccctccttatcttaaccctaagcatttctttctgatgacttcaactcttcaaacaaaacttaactctttcaaccaactgccaattgggaaaactttgaatccacctatgacttggaagccaacctgcctcctttaagatgtgtcacctttctaaaccaaaccaatgtacacattacatgtattgattgatgtctgcctgtaacttctgccccccatcccttaatgtacaaaatcaatctgtgaccttacttccttgagcacatgttctcaggacctcctgaggctatggtgtgggcatttcctcaactttagcaaaataaactttcaaaattgatggacacttgcctgagatacatttttgtttaaagcacaaagaggagatagaaaaagagagatgagagtaatgaatgtaaaatctggaagaaaatattgtggagacagaaaatgattgagtcccattgaggggaaagcatctgtcttgagcaaaaaagatcctgacagatggtcagagaatatgttgggagacacttttcattgtgacttttttctccccaaaattttccataataagccatttctcatcccttgacccaacatggttggtctctggaacaggagcactgttcacatgctgctcaagaatggtggtggtaacagcagagcagctcttgagactggttggtggaaaataagtatcaatgagggtatgcaggacagctcatctctaaaaattactttgcctgcataaaacataactccaagagctagaggattactctttggttctggtttttatggcagcttcattacgtagccatgattgattaagtgattggccactggtaatcaacttaatttccagcctctttctcctttcctgaggttggagggtggggctgaaagtaccaactcactaatcacacggttcccctggccaccagccccttcatccttagagattttccaaacgtcaccttattaacataaactcaagtgtaatagaattgggcttgttatgaataataaaagaccctcctttaaactttataattttgaagctatttcaggaatgggagaaaaaacaattattctttgaaaaaaggtattcctcttattcctataactcaggaatttgcaagagttttacaagttctgtgatgggaaccagggacaaagaccaaatatctgtttcttatatcacaagttttcaaaaaccaattaatacattatttattcatttattcatgtatagatagatggttactgtcaaaaataaacactttgtgtttataggtaatgcagcaattacaatatatagggcacgaatgaagcttcacaggtgtcaagactcgaaatcttatagactaagttctttggccagaatgcaatacaattggaaatcagtgataaaagagccacttcaaatttttattttagacaattaagtaagaaatcaaagagattttgaaaagtattagaatattatgagctgttatatgatactatatttgaaaacttagctgaaatggtaaattcctatagaaacatgaaatttcaaaaatcgttgataaagtaaagagcataaaacattcagtatgtgttaaagtaatggaaatggtcatcagaagagcaacaaataagttctacaaactttcacagaatagctatttattaacttacaaaagttgttccaggacaaaaaaataaagctttcccagctcattttatgaagcaagggtaatctttattccaatatacataaggtttctaaaaagccattcttgagggtgtgtggccaatatgctgcttgttcaagattaactgagggattagcaaagaaagctcagaaatataatcatgtatttgtagcagatatgctaagtgacagaactggaatgcccagttagtagggaatatgtaaaggataaaggccactaaatggagaaaagttacgttcaatttctttcattcaatatataaatgttaactccagagtgcttaaaaaccttaaacactatcaagctaaagtaagaaaatgtagaatatcattgagccctggcgtaaggatgggggaaagagatagtataccagattctcaaacaaaagactataaaaaaagagttaatggattgtattacggaaatattaaatatttcattaaagaaggaaagtataggtgatgttagcaaacatagggcagattgaaatgagggatttgcagcaactaaaaccaattaaaagccaatctgttaaatatggaagaaattctacaaatccataagaagaacacaaggaaatacagagaacaaacctaaatatctagaattatatgaaaagatactcatcctcaccaatagaaaactgcgatattgccttatacatattaggagatgcatcttaggaaaaaatagagctttgaattataccaagcattgttatggatggagtggtgtgtgtggcagtgaccagaatggatgcaaactgataaggttgatctggagagcagctgacagaagttacattgcatatgtgtacaccctgttaccaacaagcccattcctaggtttatattcccaagaagttaatgaaaaatcatgtgtgaagctcattctttttatcactgtttgtgatagctactggttgtagctatctctacatttatgtatctctaaatacataaaatatgattgatgtattcagtgtggcaagcacttaggagcagtcaattaggtgtacctgtgaccacatgaagattacttaatgctaccacgttacacgcacatacaaataggctccatggcacaatgtcatttacatatactaaaacacatacaaaaacccaacactctttttataaggttatatacaaatccaaagacatgtaacaaacacattagattgggtgtctgtgttggaacatagaacaggattgggggtcaggaaaagcaaaaagaaaataaaagagaatgaggtcttccatgaactaatgataattatgtgccataaactggaagttatacttaattaaactctatagctgagaccaaatagaaagaaaaaagtgtgcagcagcaaggaaatgtttaagttaacaatgctcaacatatttgtgcatctctgcagtttagaaaattgaaattttgaagggattggttaataccatattcatttgctttttgtttggttactttttatctcagttcctccttaaggagaagagcttaatccttgctgtgaatttcttttgtattatttgggcaaaatcttcaagtgtcttaataaatatatgatctttctttagtaccggatgggtgggaggtttttttctctttctcatattcagctccatgttctttccagcagatgctgctatcagagcgtgatcctcagttttcataaaaatgcacacacttacaacaaaaattgaccacactttggcagcttatgtattaagtgttcctaccacactgcgatgtatcagtgggcaaacactgcattaaatgagctatagcaaagcaatccagaagagaactatgtggtcattagaatgatggaaataactttaacaagacggtgactgcaacaatatgagtggaaacaatgcccaaacaacaatattccacgtatagtatttatagtaaaaatacgtttgaaagaaaatatgaaacacgttggtaatgatttttcactgtggtgagaagattggtcctggctgtaacagaaaccatcagtaccatcatccccacagccctccaacccttccctgtgcttcgcagtttccagctgccagggtcggcatctttgtgcctgagggctttggaaagcctctctgctgatgtgcccatacaccaaggaattgacacctcctgggggcagccctcaacagagacccatgggagttcatgtataacaccaacagaaaaacaatgcaacataaaaaattgtgctgtgacaaattaatgattcccatcagtgtgactgacagagtttaaaaatgtttacaatatgactttctgacttcctcaggtggtgtcaattcctaagacaaacaccttgtaattcattacaaatgcaaatatgtcaaacattgttctttgaaaataaataaataaaaattgatatggtattaaaatactgctgtttttcctgtctgatacataaagaaaatgtaatgtgaatacttatagtttccaagagtatgtggaaattgacattcacatatactttggtacgtaagtaaatttatagcaaaataatttaaaatatgaacaactattggtatgtttattgtggcattatttgtaatatcaaattagaaacaaagtaaatgtccaacaactaaggttttaaaaaatgtgttacagttgcacaacaatgtacttaatgccattgagctgtgcacttaaaaatcgttaaaatggtaaattttgttaggtatattttatcacaataaaacatgtattatagtgcacctaacaaagaaatgagttattaaagatgatatcgcaaagcattttatcaatggagaaatgtatttctatgtgtgtgaatcatgctataaaaatgtgcttaatatttacattgtatattatttatgttatatatatgtaaatgcatatccatttatatttatagacattgaaaaaggttacattttaacatacacttcatgtaattatagttcttcacacatttttcttttgcttatttaatttttttcaatatttctctaataagccaatcttacttaagttaaatgaaaatgaccctgtgatctcaacactttgggaggccaaggtgggtgaatcacttgagtccaggagtttgagaccagcttgggcaacatggcgaaaccccacctctacgaaaaataaaaaaaattagctgagtgtggtggtccaagtctgagctactgaggaggctgaagtaggaggattgcttgagcctaggaggtagaggttgaacaatgagccaagatgatggcactgcactccagcctgagtgaaagagacaggccctggtttattgatttttttttttttttaagaaaatgaccttgatgtggaaacatttggaataacttcacaaatatgttcttgggtgtctaatccaaacccgagaatcaataatgcttataaaatgggagaaatagggcgaaaatttatttttcttaaatttttctttctcatttctctgattcaaactttttgacctacttttttttatgaataagaagcaattgatttaaaataccttaattttatctcatttcttaattacaaggaaaacataggctgatttgtccatttttatttaaagtcattctcagaaggctttctgtgcttcacatttaagtcactttttacctgataatattatttatgactatgttttcttctattgggttgtaagttttatgaaaactgcattctggctaatttatttaatgtatttcccacagtgtccaactaaatgtgtgtttgtacataatagattcttagtatatttgagggataacaaatggcagtaaattaaccttttctttttctaccgtttttttccatttttttaaaaaaacatatggggccttaatgggttcctcccttgtgtgtttctgttcctttcactcaagctccctcctctcctctattagaaccattttcaggtatttttcctctcttagggaacatgtaacattcaatggttaagatttatggaaatgtgccccccaatatggctacatgcccattttgtatggtgtgaagaccataattttataagctagccattccattattggactgccaaagctattaatatgttctttctaacacgtgagctgcatttttttcccccatgaatctagccattgaatccagctctgcccctactgaaacggggaaagggtatggtctctcatctacatggcactctatggttgaagagcatgacctgggttcctcagaggctcctttactgggctaggtggccctgggttctcacatagcccagttttctggaccttgcactgtgatggctgttcatgaccacactgttggttagccatggtgctcccaagacagggcacagtgctcctgatttaactagccgcaaacagaagacaggggggctttgccattttagagattataatcctatcataatcatctaagtgctttggctttatttcagcaagtgtggccattgctctgttatgcagatcttatgcctctttgtcctgtttcttgatgtccatttatattctgagtgtgtgttctccagccctgcaagcttgtgctgctgacttcataggtaagaattccatattttgtttttttaacccatttgttttcacccaggttatgctttataaacattaattgataataaaacttgaaagttaattttctctctctacgaatttcccccaccctagcactcctgaatcattgtggcatcagaacagagctggcatggtttctatggcacagaaaacactgtgggaaaagggtctatgcaagacttcgggatggacactgcagaagttagggaaccaaaagaccacatgttaaaacttgctcacaaaatatcaccacttggcagtcagagagaagggccaatgccagtctgaggcaccgacttgaggtatagctttatgttagcacaaaattaatgctgattaactttatattataattaattcttcagtacattatctactctaatcttctcaaccacttagtaagaaaattttgtttattttccctattctacatttcaggaaaataagtattggaaaactacgtacttccccaaaggatactctcaagttttggcaaaaaagacgtctttcttctttgccccattgtcctgtctctgtccttagggaaagaaacatgaagaaatgctccctggccttttaactgttcttgtggtcacagctcccaaagagagtaaggactcctaatctgtgtggacagagcctaaatttctgggtgatgtttcactaggctgcagaaaaagcaggtgcccaacctccacgttcacttcctgcgtgtgtctctccccaggcttcttgcagttttgggctccatgagaaaagccagaatgggggccccatctgtgcagagtgcagccaaatgggcactctctgctccagattccagacctgctgggacaaggtctctgactaacatgtccactggccgtttgtctaggaaacagtttgtgtatctactaggttggtgcaaaagtaactgcagtttttgccatttaaagtaatggcaaaaccattatgtagtaatggcattactttaaatggcaaaaaccgcaatcacttttgcaccaacttatagctcttctagattcaagggtgacaagtagaatgctttacattgattcctgaaccttagccttgagtactgatgggaagagatctgctccagatggccatggtgttgtaatcaaggtctggcccaagtactaagagaaagtagggttttgtttttgtttttgtttttgtttttgtttgtattttccagtttctctttggctgttgtgctcatgtccaggcataggtaatgtctgagcgagtacaatttcctctctgtaaaactgtaaaggagtgagtagtaggtttcttgtcccaaagccactgccttatattcttaacattaaccttatactccaggtgccagcctgtcccaggtatagaggcatggggcttagttgattcatgcaggaagaaatcctaggtagtttcttggaaatcttcttagctttaattaatccagggaaaatctccatggatactaaggacttttcttatcctctgtcttaggacacacatgtgtggcttaagttctgtctagtttcccctactggggatttttttttcaactatcataggcattaagtcggaaaggacccctgatacacatactgattaataagagaataacagacattcattagcatattatttcatatatatgggagacacccagagaatgagtagttctcaaagaggtggctttgaatgtcagcttatagagcatcttcgacaaagtgttctttgttggtgaggagtaaatttatagagaagtgacaagaaaaaggaaagggacctggagtttccagccagggtaacttgtgggaaggcaaataactgatagataaagtctggttagcaaatgttgtcaacaaagattcctctccagatggtaagaatctaaagctgtcttcagtagttaacctttgttctccccaagggaggtcaggataccctttacctttgtaaatctgtgtcttgtttttaggcaaacacagggagggcagagagtttcttgtatctgcttcaacttgccttcagctcaacccttcatatttcagggaggtatattcggctgcccctctgccatactccagcattcctctgcttttctctccaatgtactgcgcctttcttttccatcctatcctcacattttgatgtagtgtgtgttgccccaggccaggtagcagaaacatcccctgtgcaatctctccttactctcgtcaagctacacaagcttccctctgtgaaatgaccctctcctcctgcattttatttcatgttgcactttctgctgggcagaaaccaattttgagcctgctcctgagagctgggtgaagccctccctaacactatgggtgcatcccagttccatgggtgcccatgagcttgtgatactgtattctgtttattggtttacctctgtctctacagcattacactaggagtttcttaattattccaccctttattcattcaatatatattgtgttgagcatgccccatgtgctaagagccatggcaaggtcccagagtaaaaaggatcaaaacaaacaaaagaataaaacatggttactgccctcaagtaattcacaatgtaatggaaaatccagattagtggacacacacactgcggcgatggttcaagagtcagctaatgtctgtgaatccctggaagagatgcggtttatctggatgagaagtgaggagactcagactctagcagatcactttacctggtgccctgaaaggttagcagttactctccagaggcagcaggccagggatagaaaggggtggggggtaggaacaggaaccacgcacacactgaggaatgaggctgaaatagcagtgcaatgtctttgtggctggtcaaagcacaggaaattggaagcaattcagtgtggtgggagaagagagtatggggggaggggctgggagttgaggacatgtggattggagacagaggctcaattcagctattcgtctttgcatctactctatcactccacaaggcataggctctcttttctcagtctctctctctctctttttctctttctctcagccgttattttctaatgagcaaatgaatgaagaatgaagtagacattccaaggctgcctccaaatgcctcttagtaacataaatatgtatggatgatggctgttgaaatcaccaggaaaaaatatgaacattactgtttaagtctcattattccttaagtgcctgtgtgtgtttgcttaattactttgaatggaagcatattttaacattgctatgacatctcctacggaataaatgagctaagaaagagacttaagctgtagaccacaaatggcccttatatcatgtgaagttattaatacctgcccttgttcattgattatttaagtaatttatttccatttgggacattttacctcaggtattctagtctgtgctaaaagctgcaggaaagtgcacctgtccggcctgcttggtgtgatgcaccgttcttgcacatatctgtcccaagctctggggtcactggcacccattaggttctagaaaaactgtaggaaggagcccagtgagcctgggaataggccagtggggaagtacgaagaatgagaagcacaggggagaattagggacgcactggagagtttctgccactgaattggacaaaatatttgagttgtgtcagaaaatcaaaattgaacaaaaaattttgagaggcacttactctgtttttacccctgggctaaacaaagacatgtttagatataagaatatattataggtagatagatagacagtccctggcattgtggaacttagggtttacttaaagataattacttcaggcagtattggaaatcatagtggtcaatgaagatagtagatctttactatgtgttttatcaaactgctcttattcattcatttcataacatcgtaatagctctcacggaaaacaaatttagtgggaataaaattgttagatagttaggcagacatgagcagggcaggagaggtgccttccaacccaggaatgtcaagtgaccatcaggtgatggtcaggcagttgttaaactgtctctctaaaataaaaattggtcacagccagtgctaaggaaagtctgtctcccaaaagatagaaagtacttgaagttggtgatctgctgcttcctgataagatctcaggagttgggcaagtgtgttcagacatgtgcactaagaggcaaaatggcagtttaactggtatatgaccttcctctaggaacacttggctggtaaaggaagaacgcctcaagtgagcatgcccacaacatcagtaaaccactgggcatgcggcccctcccacatgctggcaggccactgaacatgaggatagcccctcccaaggaaaaatcaagggaggagaaatgcaaacactggaaccaagccaatgtgtaaaaccacaagtcaagggccaaacagcacacttagatctcttaaatgtccacttggcccccttccaagtatacttcctttcgttcctgtctaaaacttgcctcagtctctctctctgccctatgcctctcacctgaaatctttcctccaaggagggaagaatcaagttgctgcagatccgccagatttgctgctgctaacacaatgaactttgtgaagatgagggaggaaagagatttgagaactatgctctgattttttttatcttgcccaaattcctatttaagggtcctaggggggtcatgccctacaaatcttaagttctcatcctatgggttttatttaactctatatattttgacttactttccaacctgactctggccataaattacaagacaaggaagaaaaataaaaatattttaccatgaaacatatttctttgccatattttgaaatggccctgcaaagctgttctttgtggaggaaaatgtttcatctgtaaagaatctctattaacatagctagatctttttctttcagatgcttccaatcctaaagaaacctctttaagattaactaagatttgaataggaaacaatttgccatctattgtctctaaaggcagccacaataagacttcaaaaaactttggcctccacagtcttttatcttaccctgaacattccctttctaaggatcccaggtctttagacaaactcaaccaattgtcaaccagaaaatgtttgaattcacctatagctgagaagcctcccccaactcccctacccagttttgagttgtcctgcctttctagaacaaacaaatgtattttttaaggtatttgatttatatctcatgcctttctaaaatgtataaaccaagctgcgccccgacaaccttggacacatgttctcaggacctcctgagggctgtgtcacggaccatggtcactcatattttgctcagaataaatctcttcaaatattttacagagttcgactctttttgttgacagaataacctgaagaattggaccacacttaatgagaagccgaatgtttggaaagattatcgatttgtagttgacgtttgtttaattctagggcagtatcccacataaaatagagagaaggataattttcatgattatccttaagcttaataagatcacacatgcaaagtgataggaaaattgttgttgttatttcaatcaatgtagctattatacttatgtcactcaatagagagaaactgcatgcttatgaaaggtcatatagtagctcatgggaagaacttgagctgaaacccagttcctctgactcatattcaaattatctttctaggaaatcacacaatatactcagttctctttaaaaacaccagagtccccatcttgtgctcagaatgttctcttacactccctttgcttcctcttttctactaggtgaaataacagcatcactggacgcaagaaggaaacccttaccccaaccccactgaaatgatttagatgtccaggtaaagtgtggcctccctaaaacgtgtttcccaagggtgactgaaatagcaccattgaaaattcagcactctggtttcagtgttgactttttcctctcttttcaaagttgtcttttgctgtgaaacataaatgctggtcacttcatcaacactttatcataaagattattgaattcattcaagtgactgagcccttaggaatccttcctgccttcagggaacactctgacatttggataaatgtctcacattaaagtaagtaaataaaccagacaccatttcacactagatcctagtgagaaaaagaaagattccaatcaaagggacaaaatggaaatgacctctcccaacttttcatatgtgtagattcagctggggtaatcgaaacaatggttttatcatcatgttccttccttccagttcaggcctgataggaatatctaaagacctctgtggaatcatagtaaaatgggcagatattggagcatggtagtaattattgattgagaaaatatcaatggcaaatattactttaataaccaggttagtgagtcaatccttgggttgagaccataaacccaaattcatctttgtttaaattatagtatggcatatttgtatcatgttggaaaagtcatttactttggtataatacacagatatatttggtctttgttctgaattcctggcacccagttcctagaacgcttggaatttcctgagtgatagaaatatcttttgttattcataaggaagctgtttccatcacacctgagtttatgctgatatgtgacttcaggtggagcctttagatagcctcaggatgggagtggtcatcagaaagaccaagtatttaggagactggaacttctagccctatatggccactgacctccagaaaatagggtgagacaactggagtttatgctctataaaaagtcttgaacaatgagatttggagacattttggggttggtgaacatgtcaatttgttcagaggtggcacatctagagagggcatgggagctctgtgtcacccactgtgttatgccttgccttatgaatctattccgtttggctgtttctgagttatatcctttaaaataagccagtacatagaactgaagaagcaggagagaatcataggaaccccagatctatagtcagttggacagaagtattaagtggcctaggactgcaactggtgttggaagtggggacagtcctatgggatagagccctttaatttgtggcatctgatgctcagtccaggtagatagcatcagaattaaattgaatttttggttactcagttggtgtcagagcactggggaatttgttgttggtgtgagaaaacacgtgatacctttcagggtttctcagtttatttgtaaaatggaaatactaaagtctatttcttaggttgctatgtggatttcattagatatcataaatgaagtgccttctattttgtctttcatagggtagtttttttttttagaaaaagctaggtattcttaaaagattttatataaaacagttttagttccatatcttatgagaaattttttattgcctaaatagagaggctcatagctctgcccccatagttaggatgtctcaacccttgtcactgacctaagattctccaagaattccaaagacccagctataccagggaatacagaccagcagcgatcttttgtttgcacaacatttttttgtaattgaaattatttaaaaatgggtctatagtaaggagattcacatcgaaagctttgatgatgtgcatcttctgaaaaactaaaaggtactgcagagtagtcttcatagtcacgatgcgctgtgctgaggctgctgcttagaaaggtggggcttcttctccctgcttacccacgtgtctggctgatctctcagctcagctgcaggagcttgttggtcctgaagagtggtctgtctttatttgctgatacttaaactttccttcttgaaaactgaatcactgctatttggtgcacattttcacccagtctgagtgccaccttacatctttcattctgcatcttgagaattctgttttacagtcagaggtgacaactagatcagagcattgactgctcccaatttcgcttttacaaaagagagcaaaggaagtggtgatgttaggtttgggggtgatgataaagtcagagaggggaactcccactgaagcccacattatgaaaagagctgaaccaacttgtactcttgatctccccttaaaagctggttttgtacctgaatggagagaagtgcagatattagagacctggctgatgtctggtgcttcattgccctgaatagacagaaaaatgcagacccttgggaagcaaagtgcttgacagagctgaaagtgaacagcagaggctgggaggaagcaggaccaaacaaatccagaaatcctccaaggctgtagccctaggcccagcaggtggtggtcaggacaaagtaggagcatgtacagtgttgagatcagagtcttgggaaagcacctgttacaggtcagagtgaaggatgatcccagaaacaagtcagacaagaggcaggtaagtgaacaaagtgatcacaagtcaagggaaatggtgagtccataagtttgtcagtagcaatttactttaactacttcatcttaggccatattgtgtacatgcgtatattggtttctttcaattgcatgtcaaggagatctgctccttttttttttttttttttttttggtacatgtgttgctgaagtgaacacagatctgctagcttttaatcagaaaatccacactccagggctggctactacaagttgttttgctttcttgcttactaaatactatcagaagctatattaattaagtataagggttgatagatattagaaaggttgttgattagcaataatgagcattagaaatgtgcttacatttttgtgcatttttgatattcaatgtgtgtggataaggtaaaacattttgaaaacactttctgcttttaaaggagcagacattaaaatctagtgtctatttcaccatatacccttagcgataacatggaaggttcgatatgtaaataatcttgtgttgtgctgttgctttagaaggttattggtcacagtattccaagagctgatttgctgaaatacataatgagaatattgtaacatttggtttcaaagaactttccatgcaacacattttcagaacctcaaaacagaatagtgggattttattaaggctgcatgcttacttgtaaattgtgtacatttgtagcataattcagtcttgggcttaattttataatttcctggaagctaaataatgaaagagtgttaattctcacctgtcttcaattactgggcagcactggtgagattctcaaaagaaatctattacctgtgtgtgactacagtactcaggaactgtatggatagagaagaacaagaatgacctgtggattaaaaagacagaacagaggtccaaagggagtgagtgagacgccagcaacagggacaccttctggctcagtaaaaacacttgttctgtggtggggaatggttagggttgcactagctgtaccttctgtggggaataggcaaccttgggtatggaaaatcactgagacaagattcaggagacccagttcagtgctagccctaattggtcatgtgaacttgggtaagacccttatcccctctaagtcttggcttcctgatgggttagatgaagagttaaacaaaatattcttggctggggtagcacagtgtggtgaaggcagtgagatttcgggatctttagtctctcttacaatcttaggctcactctgaatatctagggcttcttgtgcaagttgtttaatccatttaagctttaatttttttatctattaaatgcaggcgataacacctatatcaaaaaggctatttttagtattaagtaaaaggtgacatgtgaagtgtttaaaaaactgcttaataatgttaccccattcctctcatctttccctttacactcacacattctacaattctatgaattaaggggaaatgattgatggaaatttgtggcacaggcagagatggaatggggatgttatttcctcagtattgggcttgagtgatagtaaacgatgaagataaagttcacttttgaagtggaatggttaaagtaccattgagggaatacatgtttaacctaataaactggagacccattttgtagttgtattctaccccatgggaagtgcaagagacacagcacaccaaaaactaggaaagctctacgattactagtcgggactctggatccaactggaaacatcactgtgtgatggatcagaatttgaagcatgaggagaatctgggctaggcgagcacagaaatcatgcctacaccaccagtgggaagaggaaactctgtctctctgtatgtatatatgtttgtgtgtatgtttttgtgtatgtatgtatatacatgcatatatattatgtgtatatataacatatatttagtagatttaaaaattatgaaattatgataaaattgtggcttcagtcatcaacaattctttgttaagtcattaatgaatgacttttttttttttttttgagacagtctcactctgttgcccaggctggagtgcagtggcatgatctcggctcactggaatctctgcctcccgggttcaagtgattttcctgtctcagcctcccagatagctgagattacaggagcccactactatgctcagctaatttttgtgtttttagtagagatggggtttcaccatgttagccaggctggccttgaactcctgacctcagatgatgcatccgcctcagcctcccaaagtgctgggattacagacgtgagccttcgtaccttgcctgaacaaattttcttttataaaaaattgggttgctccattccttatttgacattttattttaaaaagtgatttatttataattataaacttaagcaatatagaggatgcaaggaaaaaaaactgaaaaagcagaaatgaatcccaatctaatgaaggggaattagtcaccgttagtatttgataaacatgtagatggacatgtggatgcagagatagacctggaggcagattggcagaaagatagataattaactagaggtgtctgaagattggagttgggaggggtatcatggacttgtcctggaacaagtctctttaggtgactcacccaggggatcagtgtgtctcacaatattgttctttaagtcactagttctctctgttaggatcttatgacatctgctttcttatttttcctcttcccaatttcatttccaacagtttcttagccagaaggtaggctgataataagacaatgacaagtgagagtgcttcctccttcacctccacctgttttgaaaaggagtcttgtatgtggacattcccctcttttccttggtacccctcacccctccttgcggcatcacatggctatttgagcaccatgaacctccctttcagggagatctaaatcctgcctaaggtctgagttaagactgcctgtctttcagcctcctacctcacttgtcctcaatataactgtatttggcaaatattcttccaagtgtgaaatttggagttggggcatattcttgttagtgatgaaggtggaactttcttcttgatattttcttgctgcttttatagattttagcaagttttttggaatgagacatcaaaaaagaatggctttattcaatgttcttgagccagaaatctcctacctgtgaagattctggtactcagatttaatacaatcaagtgtctcttgaaattttatgtcttagcatgccttttatttttatttttgggtgtgctataccttatttcagcactactaatagaaaaaaaaaccaactatatagacaagaataatcaagaaaaatacctcaagggccaatgtgaaaagatttttagtattttataatttataacattttataatttaatttttctaagtagtaaaatatatttaaaatctgtgtatttttaagaggaagttccaaatgaaagaaatatgaaacaaacaaagttagacatgggaaggaaaatgatcaccccattgctatgttcatcatgtcttattctcactattttaggagtgtcaaggtggcgtttaggcaccgtgtgactcctttaccgtgaatcaccctctgcaacccccaggtgcaggctgctaattattctcttcaaattttctccaggagttccctgtttctctgtcttggatatatatttggctctgcatggtagaccaggagcaccagaactgagacattaaaatcttttgagttaaatagtattaggagattattttcacaggcgcctttaaaaatagatgtatccaattactgtaattctaatttttcaaatgctagtccttttgacaagttgcagctctgtttaccagctcttgtaggagtctcatgatttcccccaaaagagcagcatgaagctgaaattgtaagtttatcaaagcaaattgcatgcattttccaaaggcaaattgcagaccaaagccatttgtagatgaatagaaaactacatgaaagagaacactctgctgtgtttgcctactcataacttcaacccaaattaccttttaaaacactatttggaaatctatagaacttcaaaagggcccattaatggatgtgttgaaaatagaacccaacttcttcaactccaaacacagagtttcactattcaacaaggaagtttcccagaataaggtttaagcttaagttcctgaagttcataggctaaaaatatacaaagtttacgttgtagtttctcatcactgtaagactcaccacatattcaaaagaccattaggaagtcctgaatgtatactgtgtcctaccctgaagagggcacagtttattaaaactattatcatatatatctaaacaaactcttttacataaaaaaggtaagtaaaaatattatgtggattaagggatagagggttgaaaggactatttcaacggcttttaacaaactcagcagattcaaaacttgaattcaggtctcaacttatctttcaagaggaaaatgctgaaagtgtacagcgagtgtaacttcgggtttctgtataatatttaatgagataaatgcctccctccctgtagtgtgggttactcagcatttgccttgcatttttattctccagcttattctcttctgtgtccagaaggctgatttccatagggggcatcaactgcattccctccccagtttcaattttgctagtaaaaagcatcagagggagatcagaggatgaaaagtagaaagattagagcatttattcctcccaccccaccccagcttgagttcaggtctgacagtgtctgcagcactggcactatggccctgagggccacctttttccatgtccagctcttaactaagctccagtaacaccaatgcctccatttgttccaccaggcctaggagtggcaaaggctcttcacccttgctagtccctaggtgtctacatatcccttgtaggttgttacctcttaccacgccttggtaaacactcccctcattaagaagcttctttgaaaaattccaactaactgagcatgccatgtgttttaggctggggtcctgacacatacaaatttgtgtatctaattttaaaagcttatttcacctcctgctcttgcatgcaattatagcgcataatcttgtggttagagataagcaaacacgctgaaactaaaatgcaaatgcaccctggaatactgtaacttaaaagctgccaccaaaataattctacagcagacaagtccatcctgcacttaggagatgagtctacgtatgcacacaggtgcttttcttagcaagaacttcttcttatgtgggtaactctaggccttctctctggtgtggagtctctgtcttgtttggtggtcctgatcgtttcacttatcatacctcctgctgaacctttccaggcaaggcagtgattcaggaaagaccgctgacagtgtagaaagtacacggttttgtttctgctggccagctagcggggaatcctggtattcagaaggggaatcaattctttctttttgatttagggatatgtttggcagttattaattaacatgtgtgagagatcctgagaatttcaaacatttattttttaaaggagtctaagtttaaacttaacttcattatataaaacttccttctccttcctcaacctcacttctttgaattattttactttagaaatggcaagttttctcaaagattaatgcaaagctcatgtcaaaatagagctctctctctctcaattttatttctactattttaactatttcatctatttatttatttttttatagttttcgtggtccattagttccatgatttaatttactattttactttaaaagattttcccttgccagtcaagtagtattccatagaatacatgagagaatacatttttgaagaaaactggtaaacaaccaattaaaactctttatggattttcttccacatataaattactattctatacatgaaataataaaaataagctttggaatgaaagtatataaaaatgtcaatagaaattctaagtatggggtaatcagccttgaggtaattgatagttgcctatacttacatgatttgtaatctgtcaatcatttattcaacaaatattttccacagctcctatacacaaagcattttaagggtagtattaaaaacaaagtactttcccttccctaaaaatctttataatttatttcagaagaagagaaaggtactttttttttggcagacggggacagagtctctctgtgttgtctaggctggagtgcagtggtacaacctcagctcactgcaacctctgcctcccaggttcaagcaattctcctgcctcagcctcctgagtagctcgcactacaggtgcccaccactacgcctggctaatttttgtatttttagtagagacggggtttcaccgtatttgccaggctggtctcgaactcctgacctcaggtgatctgcctgactcagcttcccaaaatgctgggattacaggtatgagccaccttgcccagcctcgaagaaaggtactttttaaggaagtgcaacgatagtggcaaataagagttccaagcagaatgaagcctcttcctggtagtgggaactggggcttctggtctcagccattgatcaattatcactgacaggaaccatgagacctgtgcaaatgaatgactgtgtacagttctagtcattgatctgatcctcaaaaaaagatgtgataaatgtggattaattgaataagggattgtgtgtgtgtatgagtatgtgtgtgtggaagggagtgtaaagtatgcaactactttgctatttgaagatagattaaaatcacctccatctcttccttcagcatagaaagacaaaacgtgggagaagtgtgaatgcaagtctattcaccagtttctaggatttgctctccgggtttggtgggttaggatggggatcaaaatttcaaagaaatattgcacagccaagaaaataaaagtctagtatacctattcagttgctaggcagttactaataggttgttgataattcaactactggtacgcttaggtaggctgaaatgcaattaatttgaagaattacgcagaaaaaatcctggatgagagacctagaagtgattaaggaaataagagtggctcaggcacttctctaaccattcatcaactgtgtaatggaacacaagcaatgcttttcctcaacctttaacagagtggactgctgggaagatgcattatgacacagatccaggaaagcatcatctctgagtctttctgcctctttgtgttggttgggagaggctaaaagaggtttctgaagaggaatgaccagtgttagaagaagtgtagcatgtgtgctaccatttcagggcattatagcagagaactcagaaaggccagaatcttgtaccaaactgtaaccacctcttttccaggtgagacagccagcaaagaaagacacatgaagcaaatggagccacacgtgatgatcatactgatctctgctaaatcaagctacagcacacaggagtcccaaagcttgctgggccttctctcacctgcatgttcactcttattaaattatgatgagccctctgacaaactgtcatatttgaaggaccttttaccagagaagaggagggggaggaagagagaaatcaaaaaagataagcaaaagggctgggcttgctgtgtgatcacagataaaataccaaacagttaaataatgctggagggtgacctcttatgtgacccaatcagagatttgacatttatctcctgaatgtgacatcccatctcatcaaggatttgggacagtggggatgaggagacacgttctctctccctttccttgctcagccttgttctctctgtttactctttgggcttcagtgcacttttgtggccaagcccagtttgtggcctgccccttgcatggccatctctgcagtatcagtgaaaactcaacagcccctctgtgtggccacactttttttcttttctaaaaacaatgagatacttatatccaccccatgcaaattcctccaggatattgctcttgagtcatccttgagaaatttccgtcttgaaacatgtctatctccatgttgggaaatttaattagtactcctattgtagggattagggaaagcacaactacacttttcatcagcttcaatgatttcaccaaagggcatttatttacttagttataccagctgtttgttcaccagataccgtctcctttgaccctatgtgcacacaaacccacgcacagcggatgttgactatgagaactgataatatcacacccattttagatacatcattgaggcaaaaagggacatttatgggagatatttttctttttgttgtggaaattctgacaatctcattttattttctcattcaaattattaaatgattctctctctctctctctctgcttacataggggtcatcatttgttcttttaatccatttcaagagcatgtccccttttgccgtattcagggatgattgccccctacctgaaccccatcttgctccaacaaacaagtcatataatcagagatcgcactcttagtcaaaagtctgaccagttaaagaattaattgcctgcgccagggagtatggaaagcaaaaaagaaactctgttatgatttctatagatggaaggagaaatgcactatttgaatgatagagtttaattgtcattatctagaaaagatacttcatttaaacttctcctttacttaaaataaacacctcaatgctcacattcctgcctggaacatttttagcaataactgctggttgtcaatgacaacaatcatatttaattgttcatcctgacatgctccagcactctattaagcacagattactatagattgaataaatgaatagcaaagatgctggccaagagctctgaacgtatcagtggaaataatgaattgcatcatccttccatgaaaatgcaggaagggccaacacaggtcaagagcttgttagagtttcaggttgtccattttgactgaattaaaaagaaagcaagtttattatggattatacatgtaagcagggagaggatgaaggtcaaatttcttgattaggtattatttagctattttaccatatctcaaagttataattcagaaatgaaatgaagtgtatcttgtttcttatatgaatttttaaaaggtacacagtagatagtcttactgaattttagtttaattgcactttcatctcaatattattattttatcaagccagataagtaaataatatcctttcatcaggtatcagagcacagttgtaatataaatgggattagcataatgaatgcctttggagaaaattataaaatgtcctttcatgcacatacagttttataaacatgactttcctttgttttaattcaatctctgatggaaatgcacaaattttaaaattctgggaagaacaaacttatctgatcatttttaagtaattgatagatcacagtagaattatgtttttcttttaagtgatgaggatagaaaatttgagttgtttaattagacatgtgactgaacccagacgtaaggggatcactttggtgccctggaaagtactttgtactgaatggggaagtccagatatcatattctggtgttgggctaaatactaattacaaaaccatcagacaaaattattgttattattattttgcagcaagtgactgttaacattgaatgtgtgttatcaacttaaaagtctattctttcttgaaaatatgtgtcataaatattttctcctcaaagaataaacacaccttttataaatgagttgatttattactgaactatctatttatgacagcatgcttcttccatttatccaataattatttggttaacaatcacatttcataggcttaatgttttataattgttttggtaaacctcctgaatatctctatgtgtacagaaagcagggaatgggcattttaaggggctgagatttgcaaactgtcctttagaaaatttgtaacaatgtacccagcccaataataaacaagaatgtctttccattgactataccaaatttctactttcctttaaagtttggcaaaattataagaaatattaaattattattatttatttatcatttgttgtactgataaataaccaatccatccaataacaaataatttatccaaattataaaatattaattattatttatcatttattaataaattatttattcaataataaataactcatccatgttatatatcatgtgttatttattttaataatgaataataaataatatttagtatttattatttgattatttaatttttaaataaatgagtttgcatttttaaatatatttattgacaatttgtcaagttctcttgctaatttccttgccttcttattcctagttagacttgcatgctatttgtgttgcaaatatttctcagttggtcaattttcctttctttttattatagtcaatgcaaacttactacaaaagtagtaattttaaggtttctctggcaccagaataaatgcatgctaaccaataataaatgatacagtataattttaaagtccacacattgtgtgggagccaaatggaacactgtcttcacaatgtggggcacagtctttgtgaggacaactcctctatgcccagcttcaattatgtagatttttgagagtgtcagaagtctgaagtaggatcagtggataggattctatggtcttattattattttaattatctggtgttccaaaaagtgtttcctgaaagttaaacaatgagagttggtttccttccactttactaagtggtgttttattttttccttcttagactatatgtatgatctgtaattatgcatgaggtcaaattgatgagggctagccaaatatgctaaaatgtcagtctgagaattttaagtgtaactctagcagaaaataagagcaaacttgtcctactaatactgactaccctggaggacacctgtactttaatgtctaatgaattgtttttcattgagtcaattttttttacatcaatgttcattgaatatttattctgcatcaaaccctgtattcagccctggttggttaaagattatctatttacttatcttctatgtatctatctatctatctattatctatctgtctgtctatctatctatctatctatctatctatctatctatcatctatctattcacctatcatctatctatccatttatctataaccatctatctatctatatctgtctatgtctatccatctgtcatctatctatctatcatctatctattgtctctattcattattcatctatctaccctatctatctatctattagctacatatttagctagctggcatctatctatatgtctctatcatctatcttgatatagatatacagatagagatacagttttttcctcaggaaagtcagtgttaaataaggctctcaactgagcataaggatgaggacaggtaaacgataggggaatctaattcaaatgagtagttcagggaaggcttcttcaggaaggggatcattaacactaaaacttgaagggcacatgcacttatgtgttatgtggataaattaccaggggaagtactggagagaactagagagaaagaagcaagattcaacatggttttttaaaaaagcgtgatgttaaaaaaaaaaatttacaggaaattaccctaagtcagtcagtgtttcttaaggctgagcattaagagaaataattcttggggatgttaaaagctcagatgtgtgggaactatcttaggcctgttgaaaagaaacttaatgaggccacaacaggtctgaagcagtggcaatcttgaaaaaaaacacagaaaaagacagagactgaagaccaatgcaagcaattctaattccagacccaaagaaatgagataataattataatttctaaataaagtcaactttctactaatgtacagaaagagaaacccagggcaatatttaaagtgaagaaatgaaaaaaagataacatatctgtaaaactgtgcatctataacttaattttgtaagaataaatactgcttttactagtaacttaaagaaaaaggttgtgatttagacaaataataaggaagaagtaaattgaattcagttagtgaccgattagaaatatcaagtttcttgactcaaacaccctatttatttttctaagttagagtaaggcttagaaaacagcaagtatggtcttaaaaattattagcaaaactcagaagttctccctcaaatcaggaattcctctctctctttcttactcacatgcatgcacacacacgagcagattctaatcacagtgaaaaataccaagatcgataaatatgctattcagatataagaaactttaatattttataatatttgccctatatttttaaaggaataatagggttatagttaaaacctgttttgcattaccatctcagtcttacttctttcacttcttccctttgcaaaaaatgtcattttactgaacattaaatatttagatctaggtcatttcctttaaatgctgtctgaacatttacgtatgaatgtattacaatttatatacccattcctctaataatagaaatttaatattattcccagttttcgatattacaaaacattgcaataaatatcaatatttgtatctctttgtggaggttatcaaagttcccctttagcgttcctatttagaaatgggagttctaagttgcaacagatactggtgttactaaatctcatccttttcctctattttttagttcatgtttctgcccccacttgtacctaatcacactcaccaaaagggtggtaggtgtggctgggtttcttgcctgtcactgtgtgatggtttgaagcagctaatcctttcaaaagctaaatggaatgcaaagacttagccctattttagagataaagaaggctaagttagaacacaccaagtatgttttttagatatcatcaagcaaatggaatatccattattgtaactgaaaagtctgggctgtttcaactgagttcaaaagccacagtaaaacatcaatttagaagcaagctgttagagaaaatatgcctgtgaatgtgtatgtctgtgtgtgtttgtgtataaaaatatatgatgtagcttataacacaaataagtcagcctcctacccactacacatgtgtgcacgtgtacacacagacacacagaaaaacatgcattgtatcagggctatttgcagaccacctataatattggattataaattactgcctttaataacatagttttgccggcagcttggtaggaagtccccagtaagaattaatttgaaggatatagttgcaacgtctttctactttccaaatatttcccttgtatacttcaacagtgcctggtatttcaacattagtgatttattcacttgttttcaggcactgaaatctccaaaggtcctactttcaaaataaaattttaaaatttatagaagaaatgtattatgccactaagatcagaatgattgaatagatctaaagcatttataaccatttccctttcaggggtgtccaagggagataatagagtcatagattcttagttctgtttctggttgggccagcgaaataccttcctcatcccttttctgcttgtcactagagacagaaactaaaagccatggctcaggctgccaaaagcttaaaacaaaacaacaataacaataaaataaggcaggttggacaagcttgtgggatggtgagggtgtaacaagtcctggagaaggtatgttccaatagacagcaggcaagagtagatgggagagggcttcccacagtggctcacctagaacacatctctaaatgtcttctttaaacaccatttcctttccccagcatagctgataaactctctctatattctcacccatcgaggcctctttttatcacacttcatttccttccttattctaactctctgtgccctcaggttctgagctactcctgccatgggcagcccctccacaccctcaacctcaacaaggctcatgtgattctctcttcattccagggcaatatttctcaatcttggcatgattgccagtttgagcagattaattctttgttgtagaggcaatcttgcgcattataggatgcttgctagcatccttggcctctagtaattagatgtcagtaggatctccccagttgtgacaaccaaaaatgtccctagacatggtcaaatgtgccctgggggacaaacaattgagaaccacttttctggatataatctctatctcattacactggtaattgcaatgcagagtagtgtcaaacataaataatgagattcagaaactatgtgaagtatagtgtttatctgagtgcaaagcttgaagatgaccacctggaaaacacatactctaaaacaatgggtcttcgttcctaagtggataagtcaaggtttcatttatatagggagagttgcaacattttccatacaaggtcagtgcataggttatggcaacttgataagttacagattgccataataaaaggaagattgccttgacattccatgaggaggggtgatgatctgagtggggtcttatctctgctgccacaaggcctttcttaatcatttataggaaggggaagaagttccagctgcacactatgtgactcatgccacatagccagaatcctctctgggttcaaaatgccttaaagttccaacagtttcaagtttgaattatttaattttacagtagaaaaagatgtcaggaagagtactgagaaagtatctaacccagaataaagagttcggagagggatccctaaaggatgtcagaaatgtcaacgcatatggttgggaaagagttttctaggttgagatacatcacatacggaagcctgctgataaatgataatgaaacatcaggggaaatattaagtaattcagagtaccagcagggaagtggtgaaatactgctggaggaggtgggtgaaaggaacaggatgaagagtgttgtgtactaagatgagtttgaccttctcctgaggtcaagaggggaccaccgaagcattttaaacacacaaatagtttcattttagtaaagttcttctggtagcctgtggaaatcaaagtcaacaaacatagagactattaggagactattatacatcttagataacattcgtgtaatgtttagggcaatgtggtcattgactaggtcaactaggtaaatcttagtgtcatcctctttctacatcataatttcaacaaagccatggctgttggcgattcaaaaaggaaatatcattgtcacatagtgagtccggaaagaaggtaaaacatgctcatgagctcttactcatatttttcattgtatttttttagaatttaatttttacttattattttctcaatctataaaatttgaaattctcacaagccttagcatgtaaactctgttactgtcttcacacctttgggagatctcatccagtctcagggccataaatataacctatattttgttaactttaatttacatctctagcttgaattcccccacttaattcccaaaaacaactcaacatatcaacttagatgcttaatagggacccctcacaatctatcagtaaattctgaaagcactataattaatagacatatacctatacctaactctctctctctctctctcacacacacacaaatggttagtttccaacattatttcttcttactttttctctaaaactggttacagtgtgagtttccattttataatcaatctttactcagctaacactagctattgcgctttatagttaaacattagactggccgttatggcttactattatgagaatcaatgttttatttgacactttgtgcctcaaagctgcttattattaaattgtggcagcactattacttcccaaatgtgttggcctcaacctaatccccaaatccttgtaggcacatgtccatgggcatgttattaactgaaagtacttactcacacagccttaccaactttaaaaaaacaaggaaaatctgaaggaaaaaaaagtcatgtaatattaatagcacatattgtattataaattattctgtaacaaataagcaaatgtaaaaatgatgctgtattcaccccccaacttaatcttgtgtagtggcatactgtgaaatagcatatctcatttcccagtctaatgagttattgtaaatactgtttggtcaaaattacatgtgtataaaaccttaggtctcgtgtttcttgatatttctgtgtttgaagtctgtggtaacttgtcatggcagcctgaactgactaagagaggacccattctgatgctatcaaatattaacaaataattgagatcctgctccactgaagacttctttgtcctcaattgtagatggagggaatgggctgttaatagaaatgattgtaagaaagtccaaagtggtttggtatggtacatttaataatttaaatctgattatgctattttcccttttggtttaacatgtatcaaacaaacaaaaagtcatgtcctggtcatatggtgccttagatttagggaaaaaaataaaaatagaaaataaaagagaggaaaagagatacctcaatcctttcatcccactgtgcttaactgaaagaactgcatttgataactttactttgctatcgtttaggagactctccttaatttgattctgttcaacttatccagatgctatttaacacatgtcttctgtagaagctgtcttacttcccacactccctcccacttttatacattagtcaaaccattacctcatccctgaaatgacctctctccctgaatgcctaagtttacctactcctcaagacctcctcctattttatttatattatgcttttactttttaattcatgatgttcagtgtgaaaaagttgtaagattaaaaacattaatttccattttaaggaatttatagtattctaatcggtaaaacactttcaatacaaactgatatattatacaaacaataatatagccttatacatgtatactattagtattctaattggttaagcacactttcaatataaactaatgtattaacatagcttatacatgtaatatatatataaaatgtataaggctatgttataattattaatactatattaaatgtattaagcaaacataaaatagccttatatgagtaaaaagtagaagcgtctggagggaataggtgaaattcagagaggaatgtttaacaattttgtagaatgggaaattaggagattgggaggagaagttcaggaagaattcacataactgcaatgatcctcccttctgatactcttatctgccctatcatttgtgacatcttatacattggacccgccattttctctgtgtactttatctttgtaatgagattgtgaattcatgtgaagagcagacatgagttacctattttctctatttgacagaatgcgctgcagagttcctatcatttttcttttcttttcttttttttgagatggagtcttgctctgtcacccaggctgtagtgaggttccgcgatctcggatcactgcaacctcaacctcccgggctcaagagattctcctgccttagcctcccaagtacctgggattacagacacgtgccacaacaacaggttaatttttgcacttggagtagtggtggggtttcaccacattggccaggctggtctcgaaatcctgacctcaagtgatctgcccatcttggcctctcaaagtactgggattacaggtgtaagccaccacgcctggtcccattttgttaaagttttgacattttctgaaatctggggtcttgacactaatccattttcagcaattgaaataaaaaaattacttgatgacagggaaggcaataaatattattaaccaaagtattcttctaatgcactagaaaatgatgggaagggcagagaatagtctcaaaaacttttatcaactagaactgtgtgatgcaaatgctcagcttcatatttgcctcaaatgaagctgagctattctctttgctttcccatgtagggagctggacttggactacccacagcctttggtcggctgatggctgtttaatcacaaacaaagagattccaggacaagtaacaatagcttttgtttaaaaaggacttcatatgtcacaaaattcattatcacctgtgcattggttagctcaggcttccataacaaaatacttcagactgtgtggattaaacaacagatcttattttatcatcgttctggaggctgtatatccaagattagcctgccagagtggtaagggtctggtaagggccctcttcctggcttgcagatggtcaacttatcactgtgtcctcagatggccttttctctgtgtgcacacagaaaagagagagagagggtgagatagacagagagttagatctctggtttctattctcataagaacacttaattactctcttatggtttccatttctaaatacagccacactgggagttagggcttccctatgtgacttttggggagacacagacattcaatctataacaacccgttaccacctggaatcctcagattagtaaagaaggaaggacaagaattaatataaccatttgccaatgaagcactgaatatcagggagcttacagattgttccaaatcatagaagcagcaaatcttagaatttttgaaaccagaagttgtgtgcaagtgtttcttccccatgtttctgtccattactgatgttggtgccaacttggagttcaatgcagaagtcttgtggaatatgagggtaggaaagctgggttatgtgcattttagaatgaaaatgtgaaccatctagaattttatctttatcttggcttttaaaaaaaagaattttccagatgcacttaatgctctaggaggtaggcagaggattagaaaagaagaataagacaaagttgaatgataatgagcttcagggcatcagaataagacctctggatctgaatgtttgttataggatactttttagaaaaaaaatgtgttattttaaaccatgttgtttgtcatagtgaaaggattatttatattcattacttgttaacattggtcttttaacgtttttgtagcttcctgtaagcattcatgaacaacaaaaatgttttcttttaagagagtaagaaacaaaaaggacatgcctataattcttattttgaaataagataaaattacttagatacaaggagatattttgggagaagatgtcttttactacttaataaaatttactttcttcctcaaagataagaaaacaacagtaataggaaccagaacaaaacaaccttcttgatttctaagaaattgaattaattttcccttcaatgataatctttttcatccccttcttttttttttttcttttttttcttttttttttaacaagacctagcatcagctttggtagagcaactgactaaggaggtacacacctttctttgaagttaggaccttctggctttccctaggtcatgaagacatgtcattttgcccagcacctacttcacctggctcagaaggaggccaatgcacacactctgagtgcttatctcactttccctccattctgcatattcaggcactgttcttagcaacacagccttttccacaaggagagttgcaacacatttttctcaggaggagggagagggaagtcgactttcctactacttgcttaaaatactcaattgctccccagtgctcatgggatcagatacccactttgtaaacttctccaggaggttctgtgggggcctgccttctctccctccccagcctccatttcatcgcttccctattcacattatatgccctacctcagcaaaagccaggctgtttcttgactttttgctggctgctttgtgtttttgtttttgttttggtaaaaacacataatgtcaaatttaccatcttagcaatttctaagtgcacagtacagtattgttaactatatgcacatcgttgtgcaacaaatctataaaaattccatcttgcaacactgatatgatctggctgggccctcacccaaatctcatattgaattcccatgtgttgtggggtgaaactggtgggaggtaattgaatcatgggggcaggtctttcccatgctgttctcatgatagtgaatatgtctcatgagatctgatggttttaaaaataggagtctccctgcacaagcgctcttttcttgcctgctgccaatgtgagatgtgcctttcactttccaccatcattatgaggcctccccagccatgtggaactgtaagtccaataaacctcttccttttgtaaattgcccagtctcgggtatgtctttatcagcatcatgaaaacagactaatacaaacactaaaattctatgcccattgagcatcaaatttccttttcaccctttgctatcccctggcaaccatcattctattttctgtttctaagagcttgactactttagatacttaagtatctcatatgagtaggattatgcagtatttgtcttttagtgaatggcttatttcacttagcctaaggtcttcaatatttatccacattatagcatatgacaggatttccttctttttcaaatgtaaaaaatatttaattacatgtatataacatataccacaatttgcttatctattcatccatctatgaacatttaggttgcttccacctcttggctagtgtgaataatgtttccatgaagatggtatgcaaatatatctttgagactttgttgtcaactatcttggataaatacccagaagtgggattgctgaatcatatggtagttctattttcaatttttggaaaacctccatacaatttttttatagcagctgtaccattttgcattcctacaacagcatgcaaatgttccagtttctccacatccttgctaacactctttgtcttttgtttctgaaaatagccacccagacaagtgtgaagtggtatctcatggttttagtagcatttccctggtgattaataacatggagcatctttttatgtatttcttcaccatttgcatgtctttatggagaaatgtctattcaaagacaaaaaacaaaaaacaaacaaacaaaaacaaaaaaacacactaaattaattaattaattaattaattaaaaaattagccaggtatgctggcatgtaccttgggaggcatgctgatgtatacctaatcttctcgggaggctgaggtagaagaatcccttgagcctgggagtttgatgctccagtgagctatgataatgccactgcactccagtcgtgggtgacagagcaagttcctgtcacaaaaagaaaaacaaaaactttaaaaaacttatatactttgttatttttaattttaaaataattctatagctttttttgtgtatgtggttaccttggagcttacacaaatatcttattgtattacagtctatttaaagccgatagaaacttatattcaattatgtagtaagactacacttcaattttctcccatacactttgttatttttatcatgatttatatttattcatattatgtacctttcaacatatttttagttatagttattttaatacatttttcttttaacttttatacaagtattagagcaatttacaatgattacagtaacagtattatgtacttgtctacatatttacctttgccaacgagttttatattttcgtatactattgtgttgctattttgcatcctttcatttcaaccttaaggactcccttttgcgtttcttttaaggcaggttttgtgatgatgaactccttcagcttttgtttttctgtgaaagtctctatcttccctttttgttttaaagaagagtttttccagatgtagtattcttgattatcagtttcatttttttctttcagcactttgaatatattattttactccttccaacccaaaaagtttctgctgaaatgtctatttatagtctcatggaagttccttgtatatgacaagtcactctttttctcttgccgctttcagaattcttactttgtcttttacatttgacaatttgattataatgtgtttcgatgtgcatgtattcatcttatttcgtgtctctgggcttctgggacctggaacttacttctacagatttgataagttttagtcattattacattaagtcacttttctggttctttgtttcttctttttctgggacttcagaatgtgtgtgttggtcaacttgatggtgtcccataattcctgtaagttttcttcactcttttgcagtctttttgtctttatgctcctctaaattatttccagtgatctgtcattggatttgctaatcctttcttttgcttggtctagtctgctgtggaacctctctagtaaatttttcagtgtacgttgttcagcccatgatttctgtttggtactttttaagatttcccatctcgttgttgaaattctcactatatttttgtgtccttgatgagcatcttgtaattatttttaattatctattggataaatcatgtaaggttggtttctgtatgtttatcttgttcctttgtttagaacatttttacctgattcttcattttttcttgaccctctatgttggtttctgtatattaacaaagcaagcacctctcccagtcttcatggactggttttataaaagagaacactttcaccaacaaatacagccaaaaataatggtggcctataataattctttccctcctgaggaggaattaggcagctgtgatttttgtccatttattctgtgttgagccagagagagggtagctatggtctacaagcccaaaacaccattttcatacttctctgagcagcttgactgtgctgggcctgcttaagtcagcactggttagaaatgctagttattttggcatccatggagaaaagttagggtgctggacacatggataaattctttcctttcctatggagaatctttcagcttgttttttaaaacctacttgctatgtgctgagcaaggggtataatcactggcatctaccaggctaaactgttgccaacattctcccctgggtggttggactgtgccagacccatcacagccccaatattcataggacagcaaccagtttgctgagagcccccttgcagaagtggagtgctgaacacacaaaccaatctcttctctcccttgggtgaagctagaaggaagggcatatgttcttgatccaatggcactgtgcaagggagggatttctggttagaaagtatcctgaatttccctactagcttcgacaaatctggttaagctttcttctgaggtgcaggagtcttttaattcgtttgtgattactcacagagtgggctgatttttgaattgttgcttaatcagtgtgtttgtgggagaaaataggaagtccaggtcttcctattctgccactgtgctgatgtcaccttttgcttttgtcttggtaaccaaaaagaaaatacctatagaacataaacattataaaaaaaaaaaaaaagaaaaaaaagaaaaggtgacatcagcaagatggccgaatcagaagtcctggaccctatctcttttcttctgggacttttataatggatatacttgtttacttggtgggataatataagttttttattctttctgtctttattgtttttccttctgatccccttggtcaataagttcaaataacttgtctttgagttcactgattcttctaataaatgaagagtgtttttgaaactctctagtaaagttttcaattaagttgttctattcttcagcttcagaatttcagtttgaatcttttttgtagtttctaactccttattgatactctcattctgttcatgctttgtttggttgtccgtctatttatcttgtagctcattaagattctttaagatattttgaattatttttttagaaaattcacagagctctcattctttaaatattaatttttagagatattttttcttttgattgagccttatttccctgtttcttcatatgctttttttggccaggatttacttatttggaaaaaaagatctaaaattctcaggccataaggactggcttcatgcaggggaagatctttactaattattctagtcagagattctttgggcctctcaaatcttttctaaaaatgtgtcttctctgtgcttgtttgtgtaatttcctaattacaatggtatataggattttaagaaaatctcataatttcttgctccttccactgtctgtctgtgctgctgctggttctctggtgttgcaacaaaccactcctttgttctcagtggctctcaggcatccaatctattgcagctcatcatcaatgctcttcaccaggtgaaacagaaaccagttccatagacagcttcactgaaaagtcagaaaattttatgtacactcacactccactcttctatttccctctcaaggaaaaatttgtgagttgggcatgttctcctgattgcactaattgtgctggcttggtgggagggctgttagtgaaatgcagcaggttttcttactcatttcaatatagctattgtttgctctggggtattgtgacttcttaattatttccagagttctcataaagactttttgaacatatattattgttaaatttgtatctctgttggataatgactctggggttcttaatctactatcttgctgatgtaacccttttcaaaacttcagacttttaaaacactttttattgtgataaattggagacattgtatcatttacagtgcataaaaatttagaacaacccataattattctctgttttagtatcttccctttcaatatttttccatgctttttataatgttgctattataatgaacaagctttatttaacattatattctaagcactcaccgtaaaattataaactactcatagaattattttagaagttttatgaattctgctctgagagcattcacctacatatatatatatatatatacaactttttgctgttatcaataatagctaatattattgctaatgatacgattctatacctaaaaatctctaaagacttcaccaaaaggctcctaggcctgatgaaccatctcaatgaagttttgggctaccaaattaatgtacaaaaattagtagcatttgcatacaccagtaaggttcaagctgaaagtcaaatcgataacgcaaacacatttacaatagccagaaaaaaataaaatatctaggagcatatctagccaaggaggtgagacctctcaaagacaaccacaaaacactgctgaaggaaatcatagatgacgatatcattaaaatatctacactgcccaatctatactttcaatgttatatgtaccaaattaccaatgttattttttaaaaaagaattagaaaaaagcattctaaaatttatatggactcccaaaagagcctgaataagaaaagcaatccttagcaaaaaaaaaacaaagctgaaggcatcacattgcccaacttcaaaatatactataaggccatagtaatcaaaacagcatggtactgttaataaactagacacatagaccaatgaaacagaatagagaattcagaaataaagcagcacacctagaaccaactgacctgtgacaaaatgggcaaaaataagcaatgaggaaatgactccctattcaataaatgatgctgggaaaactggctaaccatttgtggaagaatgaaactagaccactccctctcactatatacaaaaaataactcaagatatattaaagacttaaatataagacctcaaactataacaattattgaagaacacctacaaaatactctctcaagtatcagcataggcaaagagtttatgactaagtcctcaaaagcaatagcaaccaaaacaaaaactgataattgggacctagttaaactaaagagcttctgaacagcaaaagaaactatcaacagagtaaaaaggcaccctacagaatgggacaacatatttgcaaactatgaatgtataaaggactaatatgcagaatctataaagaacttaaataaatcaacaagagaaaaagaaagtacaccattaaaaagtgggcaaaaagtataaaaagtattctcaaaagaagacataaaagtggccaacagacatataaaaaatgctcaacatcactaattagagaaatgcaaatcaaaaccacaatgagaataatacctcacaccaagtgacacgcacaatcaggatggctatcattaaaaagtgaaaaaataacagatgatggcaaggttgcagagcaaagggaatgcttatacatagttggtgggaatttaaatgacttcggtccctgtagaaagcagtttagggatttctcaaaaaactaaaaatagtactacaatttgacccagcaatccctttactggttatgtaagtggaaaataaattgtcctgtcagaaagacacttgctcttacatgtttattgcagcactattcagaatagcaaagacaaggaatcactggataaagtaaatgtggtacatatacaccatggaatacaatgcaactatgaaaaataataaaatcatgtcttttgcagcaacacagctataactggaggccattatcctaagcaaattaacacagaaagacaaaaccaaatattgcatattatcacttataattgggagctaaactttgcctacacatggacataaggatggcaacaacagtcactcgggacttctaaaggtaggaggtaggtggggagaagagttgaaaaacttcctattgaatgacaagatcagtagaagtccaaacctcagcatcacacaatatactccataacaaacctacacatgtgccccctgagtctgaagtaaaaaaattaaaaactaatatttgtataacagtatctctgtgttaacatctaccaagaattctgtcttttatctcatattcctatatgtggaagatttcatccatccaagagtggtaagcaattgaaatatgatcatgtttacatagaaaaactagcatatttaagatatttttagcttaaaagagcagaacgtcctggtcttttgaaagccctgcaagataatttcaagaagatgtatcagcacattttaaaaagatagaccatctaggacagattttgagatctcaacaaggtcactaattctttattacacagtatcgctaactagtaaggttgccaaaatggaaatatcaatacgaacatccataatcagtaacaaaaaataattgagttgattgtggagcttttcattgaagtcagaatactggaattatgataaactaatcgactatagataaaaattatccatctatctattttgtgtacgtagagttctgatgcttgtaaattcttcaagggagcaaaatggacatattcacaagaaatataaaagaatatttcctctattaaagaaaagttttgacatttctccctgtactatatttacaaagcaaatgcaaattattaaggattaaaaaaagttttaaaatagaaactactatcatatgagtgtatattaaatcctttgctacaaaagagaatatgcatattctaaaacagattggaagattaaaatatttaccactgtagaaagcaaatttagatttagggaagtagagatcttattgaccgaaattattgtagtaggaagaatgtttcaactacaggatctgaaaatgtccaaaagtcacacagaaaaaaactcttcttttatatggaggggtaaagtagcctagaaagaataaggtatggggcagtggttgagcatgtcatgatctacagttattcaacgaatgatttatctgaagctcagcctgctcttgacaggggttgttaaggagaagttgtttcatattaccttgcccaagagtggtccaaagttgaggaacttgaaggaaggaatgaagcttaacttaaagggtgataaagtcaaaataacaatcacatttcatatcgatcagtggggcaaaaatctcaggaacccttgataagacaaaaaatgggaatttgatgggtctatatctggcttttttctgtgtaaacaggggactctcattaaatttaatgaagtcccacaggaaaatatgcttctttgcagtaagctgttaccaaggaaacaaaggtttgggggataaagttccttaaactttgcaattttccaggattatacagttggagtaaatttcaacattgtcactaaaaaaaaatccttgtctagacctatgttttgaagcattttctctatgttattctccagtatttcatagtttcagatcctaaatttaagtccttaatctatttgagttgatttttgcatgtggtgagagagagagagagagatctagtttccttctttgtcacgtggatatcaagttttcccagaacaatttattggggagacagctttttctccagtagatattcttggtgcttttgttgacaattagttcatggtaaatatctggatttatttctgggttctttattttgctccactggtctatgtattcgtttttatgccagtattatgctgtgttagttactatagctttgtactatgtttttaagtcagatagtgtgattcctttagctttgttctttttgctcaaggctgttgtggctatgtgggtttttttcaaactaaaagcttctgtaaagcaaataaaacaatcaagagtgaagagacaacatatagaatgagagaaaatataaacaaataatatgttttataagagatctatatccaaaatatataaggaacttctataatgcaacaataaaaaacaagcaacccagttcaaaaaataaaaataaaataaagaacttgaatagacatctattaagagatacaaaagatatacaaatagacaataagcccatgaaaagatgctcaacatcattaatcattaggaaaatgcatatcaaaaccacagtgagataccacttcactaccattagaatgatgatatgggttggctctgtgtccccacctaaatctcatgttgaatgtaatttccagtgttggaggaggggcctggtgagaggtgattgaatcatgggagtgaacttcccccttgctgttctcatgatagagttctcacaagatgtgtttttttttttaaatgtgttgcacctcctgccacccctaccctgctggccatataaagatgtactggctgcctctttactttccaccatgattgtaagtttcctgaggcctccccagaagcagaaacctgttcagcccatagaactgtaagccgattgaatctctttcctctataaattactctgtctcaggtagttctttctagcaatgtaagaatgaactaatacagatgactattacaaaaacaaaagcaaaagtaaaacagaagtaataagcgttagcaaggatgcggagaaattggaattcttgcacattgctggtgagaatgtaaaatggcatagccactgtgaaaaacagcatggcaattccaaaaaacaacaaaaaaacaaaacaaaaaaattatcgtaaccatatgatccagtaattccacttctgggtggcaggttctagtttcaatcacctcttacctaagggcaagggcactatgcattcctgacaacatatgtgagcatcctcttccctgtccagcagcacattctcttggttatatctttcctagatctattctgatcctaattctctccactaagtcacttcatagaggagagaaataacaagtattccataggccaactccattactacaggacagaatttttcattctggacttcaccaggcctgcctgtcttcagcacagtgctcagcctgaaatgaaggcctcaacagatattggtatacccatgttcattgtttacaatagccaaaagttggaagcagcccatatgtctactaatggattagtgggtaaacataacgtggtacataaatatagatggactactattcagctttaaaaggaaggaaattcagacacatactacaatatggataaacattatgctaaatgaaacaaaccagtcacaaaaggacaaatactgcatgattcaaacccatatgtgatattcaatgtagtcaaatttatagagagaaaagtagaatggtatttgccaggagctgggtgatagggagaaacagagagttaatgtgagtagtttaagctttgcaagactaaaatgttctgtgggttgatgatggtaatggtttcacagcaatgtgaaagtacttaatgctggtgaaatggctaaaatagtaaattttatattatgtatattttaccataagttggacaaaataaatttttttttgaaaaccaaaactgacaaatttttttcatgtttgattgggggaaaaagatacaaatagtacctttattatataagaaaggagatataaatttaaatactgtggaatttttaaaacatgaaagattatcatataaaatgacattacaacatttgaaaatacaggtgaaacagataaagaaaaatgattaaaattcacttaagaatgtatgaaagctctgagtaggctaatatgctttagagaattgaatatgtagtaaacatcactaagtaaagaaaaaacctgcataggtttgtgagtaaattaaaaatttaaagcaaagaaagcaaatatattgacaaaaatgctttcagcacacaaataagttcttattataaaacattttataaacctaaaaatactttttcattaaacatattttctagctcagtttacaagtctcgcatttttataaaaaaatgaacaaaagtagcacacaaaatgtaactgtgaggttaatttgttttaaagggttataatgaagaaattatatgataatatcaagacacacccaagctattattaataaattctcattaaaatataaaaatcaaaaagagactgctggcaagatggccaaaaaggaacagctctggcagctccagcgagaccaatgcagatggcaggtgattgctgcgtttccaactgaggtaacctattcatctcattggaacttgttaggcagtgggtgcagcacacggaaggcaagcagaagcagggtggggcattgcctcatctaggaagtgcaaagagagggaggcatccctcccccagccaagagaagccatgagggactgtgctattcagcccagatactatgcttttcccacagtatttaccacagaccaggagattccctcatgtgcctacaccatcagggccctgggtttcaagcacagaactggaaaactgtttgggctgacactgagctagctgcaggtttttattattattgttgttattttttcataacccagtggtgcctggaacctcagtgagacagaatcatttattcccgtggaaaggggactgaagctagggagccaagtggtctcactcagggggtcccactcccaaaaagcccagcaagctaagaaccactggcttgaaattctcacaggaagcacagcagtctgaagttgacctgggatgatcgagcttggttgggggagaggtttctgccattatggaggcttgagtaggtggttttcccctgacaggactaaaaaggcctggaagctcagactgggcagaattcaacatggtgtggcaaagcggctatggccagactgcctctctagattcctcttcacttggcaagacatctctgaaagaaaggcagcagctccaatcaggggcctatagataccactcccatctcactgggacagagcgcctgggggaaggggtggctgtaggcacaacttcagtggacttaaatgttcctgcctgctgactctgaagagagcagcagatcctgacaaggagggtttttctcagtacagcgtttgagctctactaagggacagacttccttctcaattgggtccctgaccgccaaacctcctgactggaagagacctcccaacaggggttgtcagagacttcatacaggagagctctggctggcatcagcctttgcgtcaaagcttccagaggaaggagcaggcagcaatctttgctgttctgcagcctccaccactggtgatatccaggcaaatagggtctggagtggacctccagcaaactgcagcagacctgcagaagaggggcctgactgttagaaggaaaacaaacaaacagaaagcaataaaatcaacatcaacaaaagaacccccaaaaagaaaccccatccaatggtcttcagcctcaaataccaaaggtagataaatccatgaagatgaggaaaaatcactggaaaaatgctgaaaatttaaagaaccagaatacctgttttcgtccaaatgattgcaactcctctccagcaagggcacaaaactggacaagaaatattttgattaattgacagaagtaggcttctgagctaaaggagcatgttctaacccaatgcaaggaagctaagaaccttgacaaaagttacaggaactgctaactagaataaccagtttagagaacaaaataaatgacctgatggagctgaaaaacacagcacaagaacttcctgaagcatacacaagtattaatagccaaaatgatcaagcagaagaaaagatttcagggattgaagatcaacttaataaaataaggagtgaagacaagattagagaaaaaagattgaaaaggaacaaacaaagcctccaagaaatatgggactatgtaaaaagactaaacctacgatagattggggtccctgaaagtgagaagaagaatggaaccaagttggaaaacgcacttcaggatattatccagaacttccccaacctagcaagaaaggccaacatttaaattcaggaaattcagagaacaccactaagatactcctcgagaaaagcaacctcaagacacataatcatcagattcttcaaggttgaaacaaaggaaaaaatgttaagggcagtcagagagaaaggtcaggttacctacaaagagaagccagtcagactaatagtggatctctctgcagaaaccctacaagacagaagagagtgggaaccaatattcaatattcttaaagaattttcaacccagaatttcatatcaagccaactaagtttcctaagtgaaggagaaataaaattctttacagacaagcaaacggtgaaggattttgtcaccaccaggcctgtcttacaagagctcttgaaggagcactaaatatggaaaggaaaaactggtaccagcaactgcagaaaaaacaaaaaacaaacaaacagaacaccaaaatataaagaccaatgacactatgaagaaactgcatcaactaacaggcaaaataacaagctagcatcataatgacaggatcaaattcacacataacaatattaaccttaaatgtaaatgggctaaatgccccaattaaaatacacagactagcaaattagataaagaatcaagaaccatcggtgtgctgtattcaggagacccatctcacatgcaaagacatacataagctcaaaataaagggatggaggaatatttaccaagcaaatggaaagcaaaaaaaaaaaaaaaaaaaagcaggggttgcaatcctagtctctgataaaacagactttaaaccaacaaagatcaaaaaacacaaagaagggcattacataatggtaaagggatcaatgaaactagaagtgctaactatcctaaacatatattcacccattacagtaggatccagattcataaaacaaggtcttagagacctacaaagagacttagacttccacacaataaaagtgggagactttaacaccccactgtcaatattagacaaatcaacgagacagaaaattaacaaggatattcaggaattgaactcagttctggaccaagcagacctaatagacttctacagaagtcttcaccccatatcaacataatataccttcttcctgcaccaaatcacactattctaatattgaccacataattggaagtaaaacactcctctgcaaatgcaaaaagaacagaaatcacatcaagcagcctctcagaccacagtgcaatcaaattagaactcagtattaagaaacacactcaaaaccacacaactacatggaaattgagcaacttgctcctgaatgactactgggtaaataacaaaattaaggcaggaataacaaattttttgaaaccaatgagaacaaagagacaatgtaccataatctctgggacacagctaaagcaatattaagagggaaatttatagcactaaacacccacatcagaaagtgagaaagatctaaaattgacaccctaacatcacaattaaaacaactagagaagcaagagcaaacaaattcgaaagctagcagaagacacgaaataattaagatcagagcagaactgaaagagatagagacacgaaaaactgttaaaatagatcagtgaatccaggagctgggtttttgaaaagattaacaaaatagatagactgctggccagacttataaggaataaaagagagaagaatcaaatagacacaataaaaaatgataaaggagagatcaccaatgatcccacagaaatacaaactactatcagagaatactataaacacctctacacaaataaactagaaaatctaaaagaaatcgataaatttctggacatacacaccctcccaagactaaactaggaagaggtcatattcctgaaaagaccaataacatgttctgaaattgaggcagtaattaatagccgattataaaaaaaaagcccaggaccagatgaattcacagcagaaatctacctgaattataaagaagagctggtaccattccttctgaaactattacaaacaatagaaaaagaaggactcatccataactcattttatgaggccagtatcatcctgattccaaaactgggcagaaacttcatacaaatatccctgatgaacatcagtgcgaaaatcctcaataaattactggcaaacagaatccagcagcacatcaaagagcttatccaccatgattaagacagtttcatccctgggatgcaaggctggttcaacatatgcaaattggtaaacgtaatccatcacttaacacaaccaatgacaaaaaccacatgattttctcaatatatgcagaaaaggccttcaataaaattcaacattccttcatgctaaaaactctcgataaactaggtattgatggaacacatctcaaaataataagagctacttatgacaaacccatagccaatgccatactgcatggacaaaagctggaagcatttcctttgaaaaccggcacaagataaggatgccctctctcaccactcctattcaacatagcattggaaattctggccacagccatcaggcaagagaaagaaataaagggtattcaaataggaagagaggaagtgaaattgtttctgtttgtagacaacatgaatgtatatttagaaaattccattgtctcagccccaaagttccttaagctgataaacaattgcagcaaagtctcaggatacaaaaccaatgtgccaaaatcacaagtaatcctatacaccactaatagacaagcagagagcaaaatcatgagtgaactcctgttcataattgcttcaaagaaaataaaatatctaggaatacaacttacaagagatgtgaaggacctcttcaaggagaactatgagccactgctcaaggaaataagagaggacacaaacaaatggaaaaaaagttccatgcttatgtgtaggaagaatcaatattgtgaaaagtataagtaatttataggttcaatgttattcccatcaagctaccattgattttcttgacagaactagaaaaatctacttcaaatttcatatggaaccaaataagagcccatatagccaagaaaatcctaagcaaaaataacaagctggaggcatcacgctacctgattttaaactatactacaaggctacagtaaccaaaacagcatgatactggtaccaaaacagagatatagaccaatggaacagaatagaggcctcagaaataacaccagacatctacaaccatctgatctttgacaaacctaacaaaaacaaggaatggggaaaggattctctatttaataagtcattctaggaaaactggctagccatatgcagaaaccagaaactggaccctttccttataccttatacaaaaattaactcaagatggattaaagacttaaatgtaaaacctaacactataaaaaccctagaagaaaacctaggcaataccattcaggacataggcacggacaaagacttcatgaacaaaacaccaaaagcaattgcaacaaaatccaaaattgacaaatgtgatttaattaaattaaagagctttgctcagcaaaagaaactatgatcagagtgaagaggcaacctacagaatgaaagaaaatttttgcaatctatccctctgacaaaggtctaatatcctgaatctacaaggaactaaaacaaatttacaagaaaaaaacaaacaagcccatcaaaaagtgagcaaagtatatgaacagacacttctcaaagaaagacatttatatggccaagcaaacatgaaaaaaagctcaccatcactggtcgttagagaaatgcagaccaaatccacagtgagataccatctcacaccagttaaaatgacaatcattaaaaagtctggaaacaacagatgctggcaaggatgaggagaaataggaatgcctttacactgttggtgggagtgtaaattagttcaactattgtgagagacagtgttgcaattcctcaaggatccagaagcagaaataccatttgatccaacaatcacattactgggtatataccaaaggattataaatcattctactataaagacacgtacacatgtatgtttactgaagcactatttacaatagcaaagacttggaaccaacaaaatgcccatcaatgatagactggataaagaaaatgtggcacacatacaccatggaatactatgcagccatgaaaaactgagttcatgtcctttgcagggacttggatgaagtgggaaaccatcatcctcagcaaactaacacaggaatagaaaaccaaacaccacatgttcttactcgtaagtgggagttgatcaatgagaacacacggacacagggagggtaatatcacacactggggcctgtcagggggtgaagaacaaagggatggagagcattaggacaaatgcctaatgcatgtggggcttaaaacctagatgacaggttgataggtgcagcacaccaccacgacacatgtatatgtatgtaacaaacttgcacattcagcacatgtatcccagaacttaaagtaaaattaaaaaaattaaaaataagaaagcaaaaaacaaaaagatactcactgttatatttttaaatatgaatgaaaaatataacattctctaattgcaagggttgtttatcatgtatcattttaatgacttaacaagattagcatcccatttagaattaagaataagaaagaatattgaagaagataggaaaagttatttgcagatgatacgaatgtctattcaaacaaatctaggaggatcttcatgttattaaaattaataatttgtttcagcaacgtggccaaaatataagaataaaaacgtaaaaagcaatgtatgttttaaagtctgatcagaaaccaatttgaatttttttcttgaggtacatttgcagtagaaacagagatattaaatatctaggaattatttatagatgagatagctgtacatatagatatagacatatacatacacagaataaaagcttttcactttaagacttcaatgtcctttaaaagaacaaaaatatgtctagtttcagacttttctgaaatacaaaatgttataagacagaaaagcaatttgtaatggtgtttacaagatcagatttttactgaaaattttaatataacacttacttattattaaaataatttaatgacctcttcaaaaatatacatggctattgcctaagccatacactcttctacctttaaaaaatcacttaaaaacatactccaaccagttgaaagttgaatccagttaatttctcaaagactgcttagttaatttatataattatttgcctttgaaattttcttaatatctttttagaatgtttatgtaaacacttacaatccaaacggaagtagtagtacacttaaaacacctgaagcaagttcagtgatgcaattatacatgagaatgcttagaaaattccattcaaaatcctcagtgcaagttaatcctccggaatttgtacaaagataaaattagcactatcacactaatgatgtacaaaaaatatttcctttctttggagtcatatgactagctacattttatttgcatttactattaataaatgacggttcttctgctcagcatggttaattgactggatgcacagtactcatcccctgttatcagtacagaagtgaggataaatgaaaaggaaggaagggagggaattagccaaagtgatgaatgacacatgaatccaaggggaattggaacctgatgatggctttgatacctacctaggaagagggcacttgactttaggttccatggctttgggtagctataactgagttatattcgtaaggttagaagtcacaaagttctacctcatctctgaaacaagttctgagaaaaaagtctaccaaacagcactaggaagtcccaggaatactttccaactcccaggaacgatggctggaaattgtatcacacacaaaatatcaggagcccaggcctacagctttcacacttataaagtaaatttatactattggcatggtgaatgaatatcaagataattaatgtccacattttttgctcacattgcttcttaatcttcctctttcctcctaaaattacattaaaattgttctgcaactgggaaaccagaaggctgaatcatttttggaacaacagcaagcatgcccactacaggccaggcacatcaaggaacctcactgggggaactcacaggaataaaattataaatcaaaggaaaacacaaaacattataacaccttttaaaaatattcaataaaaattgtaccttataactgaagataaaaccacttaggcaattttaaataagtgtatttaaagtgctcaatgatacagtggaaggatatgaaattacgaagaaaagaacagtgtgaaaaaaaagtcaaccagaaaaagaaatttttttcaaataaatgcaaataaaattatagacattgaaaatataatcactcaaattaaaaaaatctcagtggatggattaatatctaagaaagaattagtagatttgaagagagatctgaggcaatcacccagaattaacacagaggaatatttagagatgaaagatactgataagaatttaggagatgggaaagataagtagaaaataaccatcatgcataaagtagggtttccaggaacatactattatcaataatgaggaaataacatttgaaaacaaaatgctttcaaattttctaaaattgcagtgtcatataggaggaagtctctgggtcctgataagctaattccacatcttggctatcaaatgatggtacagaacttgaaaagcaatgaaagacctcttaaaagcttcttaaaagaaaacaccatacataaaaggaagaagaaaatgtgattcacatttttcagcaacaatgtataagagaagacattgaaacatcagcctcaaagttctgacgggaaaaaaaaaatacccgacccatgactctatatctaatggaaactatattaaacactgtgtctacaataggaatattttcagaaataggaatgaaagaaaatttactaatcggatgctttacaaaatgtaaattgacttgactcacatgtcttaaacatctcccaattttaataaaaattaagtaaatctaaattcttaattaagttttcataatttattgtgtcctagatggctggttaatttaagtttaagaaatctttatttatcaactatcaaatatcaaggagtgtacagcatacaaagaagggattaaaaaaccatatgagtttaatgccctgaaagaagaccactacaaataacagctaaattttttgttggcttaactatgtatgccaggcacttagagttacatttactttagagttatgcataaaactttcttgaggtagctattattttacagataatgaaactgaagttgaaagtggttaaaaacttgtataaagctgttaagaatagagacagaattctaaaattctaagtaattttccctcatgctgttttccattataattcattgttttttcatgatgctttgaatttataagttatttatgaaagtttaagccttcattcatatgatgaccctgataatatagagaaatagaagagttctctaattcattgatgtggaaaatacaagaaaaagcaataaggagttttaccaaagtcacagtgggcctcctataaagttggaataaaaattcatatttcaagaaattcccatatgggagcttatttttacagtagaccagagtggtaccttagaattaagagcacccgttgctcacctgtgtgcattgcacaactcttagcatcattgtgccttgacttggccacttgtagaggctcagtttgaaagaatacatgaatggaccagtcatcccgtcaccaacgtttctttctttttcttttttttttctgtactcgagttgcttaaattttcttttatatatatatatatatattttttttattatactttaagttctaaggtacatgtgcacaatgtgcaggtttgttacctatgtatacatgtgccatgttggtgtgctgcacccattaactcatcatttacattaggcatatctcctaatgctatccctccctcaaccctcctccccacaacaggccccagtgtgtgatgttccccttcctgtgtccaagtgttctcattgttcaattcccacctatgagtgagaacatgcggtgtttgcttttttgtccttgcgatagcttgctgagaatggtggtttccagcttcatccatgtccttacaaaggacatgaactcatcattttttatggctgcatagtattccatggtgtatatgtgccacatttcttaatccattctatcattgatggacatttggattggttccaagttttgctattgtgagtagtgctgcaataaacatacatgtgcatgtgtctttatagcaacatgatttatattcctttgggtgtacacccaataatgggatggctggatcaaatggtatttctagttctagatccctgaggaattgccacactgtcttccacaatggttgaactagtttacagtcccaccaatggtgtaaaagtgttcctatttctccacatcctcttcagcacctgttgtttcctgactttttaatgatttccattctaactggtgtgagatgatatctcattgtggttttgatttgcatttctctgatggccagtgatgatgagcattttttcatgtgtctgttggctgcataaatgtcttcttttgagaagtgtctgttcatatcctttgcccactttttgatttttttttttcttgtaagtttgtctgggttctttgtagattctggatattagccctttgtcagataagtagatttcaaaaattttctcccattctgtaggttgcctgttcactctgatggtagtttcttttgctgtgcagaagctctttagtttatttagatcccatttgtcaattttgtcttttgctgccattgcttttggtgttttagacatgaagtccttgcccatgcctatgccctgaatggtaatgcctaagttttcttctagggtttttatggttttaggtctaacgtttacatccttaatccatcttgaattgatttttgtataaggtgtaaggaagggatccagtttcagctttctatattaggaaaagaggaagtcaaattgtccctgtttgccgacgacatgattgtatatctagaaaaccccattgtctcagcccaaaatctccttaagctaataagcaacttcagcaacgtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcacgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaagctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactgcaaagacaaaagccacatgattatctcaatagatgcagaaaaagcctttgacaaaattcaacaacgcttcatgctaaaaactctcaataaattaggtattgatgggacgtatttcaaaataataagagctatctatgacaaacccacagccaatatcatactgaatgggcaaaaactggaagcattccctttgaaaactggcacaggacagggatgccctctctcaccactcctattcaacatagtgttggaagttctggccagggcaatttggcaggagaaggaaataaagggtattcaattaggtttttaaaatatttttgagacttgttgtgtggtccaacgtgtcatcagtcctggagaacgttctgtgtgctgatgaaaagactgtgtgttcttcagctgttgggtgaaatgttctgtaaatgtctgatgggtcaatttggtctatggtgcactttaaatccaatgtttctttgttgactttttgtctcgatagatgatctgtccaatgctaaaagtaagctatttaagcccccaactattattgtattggaacctatctctgcttttatatctagtaatatttgccttatatatcttggtgtcctgttattgggtgcatataaagtaatattgttacattctcttactgaatcaatctctttatcattatataatgttcttttttgtctctttttatagttttgaacttaaagtctatttcatctcatgtaagtctagctatttgggctcacctttgaattacgtttgtgtggattgtctttttccattccttccgttttagtctatgtgtgtctttacagaggaaatgagcttcttgtagacagcatttagttgagaaatccaaggcaatgagatatcatctcgcttgagttaaaaatgtctattttcaaaaagaaaaaaatagcaaatactggcaaatatgtggaaaaagggaactccaatttgctgttggtaggaaggtaaatgagtacagctattatggagaacagtatgggagttcctcaaaaaactacaggtagaaccactatatgatccagcaatcccactacagggtacatatctaaaggaaaagaaaacagtagataaaagggttacttgcaccctcgtgtgtactgcagcattattcacaagagcaaaaatatggaatcaccataagtgttcatcaaaagacaaatgatgcaaaatgtggtatatatacacaattgaatattattcagccataaaaagaatgaaatcttgaaatttgcggcaacgtaaatgagcatggaagacattatattaggtgaagtaagacaaacagaaagacaaataccacattttctcactcatatgtaggaactaaaaaattaatgttatagtagagtgttgaatagtggttaccagagggtaagatggacaggagagatggagaaataaggagaggttaggtaatgggtaaaatattacagttagacaagagaaataagttcgagtgttctacaccacagtaggatgactatagttaacagtaatttactatatattttcaaatagctagaagaaagaattttgaatatttgcaacataaagaaaggttaagtatttaaggtcataggtatgataatagccctgatttgattattaaatattatatgtattaaaatatcacaatatacccataaatatgtacaattattatgcatcaattaagaaaagaaggaaaaatctaagggaaaacaaaattgaggtggtaaataatatattaaattttttgtgtatataattttaaaggaaaatgatttcagggtgtgtatacataaaatatcacttggtatactttaaatgtgtgcagtttatgtatgtcaattacacctcaataaatctgtcaaaaatgtgtgaccataataatctaagccaaaattgtagatgaagaccatgcagcagtagaattgggtggagaagtcgagaaggagaacaaattattgggaaagagaagacataaataacatagacatcaatataagtatgaaagaaataataaagcatgaatttaattaatataaccaacagttaaatgaaaatgaaagattattttcaaaacagtagaagaaaatttgatatgcacattggaatataagaaaggaggggaaagaaaaactataacaaagcaaaaaagaataaacacagattaaaatggcaaattaaaataataatattagctataataaatataaatgacagatagaaaaagaaaacaggatcaggcagaagggctccagaggaggactaatctcccacagaattccagaaacacctgctgtcagcaatgagtctttgtagggtgctcaggtagccaatcagacagttctttctttcatataattgcaccacacggctggcaccccatctctgatcacacctggggaggtgcatagtgagctgacagtacagactgaggccagagatctggtgcaccacactgccaaaatcccagtccgtttcccagacccatcctctggagcttggtgttgtcttctgctggcatctgtgctataccacatgtaggtcattagggcaataacatggctattgctgtttctgtctctgagattccaagaaatgtgaatcaatacctggttattacactttgtttgcgccatgacatctctaatagaaatatgtaaagtgaaaagttagtaaaaagagattaatatttcagtaataggatgaactagcaattctaaatgattctccaccagtagaaaaactgtatgtactgggtaaataattacagccaaggttttaaatgaatcattggcttcacaagaaggtatgataaatctctaagatttagaggtgaaaaggaagaataaattaaggaagagtgaacataaattcagaagaaaatattgccctgggaatctattgcagggattggaccagattgttagagtagctctatccacattggacagatatagtcacacttccttacacatctgccatctccatgaggggaacaggccctgactagcctgctgttccaaagaggatgagagatgcataggacacccttggatatgatctggagcttggcgtcaagccaagcagaccagcctagatcagcttctcacttggtccatttttgtcttctcaggtttatcccaataaattttttgcatgtaattgtctgagagcctcaataagtctagatcagccaaccccaagacacatgctttttgattcaagccactgagttttggagtggtttgtcacatatctttattgtggcaattgctaaccaatatgttacttttaaaactgtagctggagtctcttggtagcaactatgtttacaggatttgattgagaagtaatcatccttgcttctcaagaactagaatatgagttgtggagacatgaggtgcttctcagtttgggatgtagaaagaaagaactgtgatctggtggaagcaaagcagaaaaggcagcagagagggagccttcaggagggtgttaagcctgtcagtgtgtgatgggtaatacttgtgctatggactgagcgtttgtgtccctataattcacatgtggaagcctaaacccccagtgtggctatattttgagatgggacctctaaggaagtaattaaggttaaatgaggccatatgagagggactctgattcaataggataaaaagagatatcagagagttcattctctctctcttcatgaacatgcactgaggaaaggccatgagaggacacaacaagagcggggccatctacaaaccaggaagagagcctcaccagaaaatgaattgtccagagcatggttcttcaacttctagcatccagaactgtgaatggatctatttctcttgtttaagccacccactctgggtattttcttatggcagcttgaactgactgagacaatggggatctactcagttctctgcttcagcttcaacttactcacagctacagagaatagtgctgctttaggctcacagcctctcccaggatattaccttctgtcactgatatggtttggctgtatccccacccaaatctcatcttgaattataactcccacatgttatgggagaaacccagtgggaggtgatttattatgggggcaggtctttcctgcactgttctgatgatagggaatgagtctcaaatgatctgatggttttaaaaatggaaatttccctgcacgagctctctttttgcctgctgccatccatgtaagacatgacttgcccctccttgccttctgccatgattgtgaggcttccccagtcatgtggaactgtaagtccattaaaccctgttttgtgaattgcccagtctctggggtctttatcagcagtgtgaaaatgcactaatacagtgtattggtaccagtagagtagggtgctgctaaaaaatactctaaaatgtggaaacgactttggaactgggtaacaggcagaggttggaacagtttggaggggtcagtagaagacaggaaactccaggaaagtttggaatttcctacagactttttaaatagccttgacaaaaatgctgatagttatatgaacaagaagatccaggctgaggtaatttcagatggagaagagaaacttgttgggaactggagcaaaggtgactctggctatgttttagcaaagagactggcagtattttgcccctgccctagagatttgcagaactttgaacttgagagagatgatttagggtacctggaggaagaaatttctaagtagcgaagcattcaagaggtaagttgggtgctgttaaaagcattgcattttaaaaggaaaacttagcattaaagtttggaaaatgtgcagcctaatgatgtagtaaaaaagaaaaacccattttcttaggaaaaatttaaactggctgcagaattttgcataagtaacaaggagtggaatgttaatccccaagaccgtggggaaaatgtccacagggcatgtcaagagacctttgctgcagcccctcccattacagacccaaaagcttaagaggaaaaaatggtgggccaggcccagagtccccatgctgtgtgcaggctagggacttggtaccctgcatcccagccactccagccactgctaaaaggggccaaggtacatcttggcccatggtttcagagagtgcaagccccaaaacttggcagcttccatgtggtgttgagcctgcagatgcacagaagttaagaactgaggtttgggaacctctgcttagatttcagaggatgtatggaaatgcctggatgtccaggaataaatttgctgcaggggtggggctctcatggagaacctctgctagggcagtgaagaagggaaatgtgagatcggcccccgacacagagtccctactgggcaccccctaatgaagctgtgagaagacagccactgtcctccagatcccagaatggtagatccactgatagcttgcgctgtgtgcctggaaaagctgtagaccctcaatgccagcctgtgaaagcagccagaagggaggctgtaccatggtaagccacaggggtggagttgcccaagaccatgggaacccacctcttgcatcagtgtgaactgaatgtgagacatggaatcaaaggagattatgttggagctttaaggtttgactgccctgctggattttggacatgcatttggcctagagcccctttgttctggccaatttctcccatttgaaatggatgtatttactcaatgcatttacccccattgtatctaggaagtaactaacttgcttttgattttacgggctcataggcagaagggccttggcttgtctcaggtaagaggttgaaatgtggacttttgagttaatgctgaaatgagttaagactttggaggactgttaagaaggcaagattagttttgaaatgtgaggacatgagatttgagaggggcctggggtggaataatatggtttggctgtgtcctcacccaaatctcctcttgaagtgtaacttctacagttcccatgtgtcatagaaggaacccagtggaaagtgatcgaattatgggggcgggtgttccctacactgttcttctgttagagaatgagtctcacaatatctgatggttttaaaaatgggagttttcctgcaaaagctctctctctttgtctgctgccatccatgtaagatgtgactggctcctctttgccttccaccattattgtgaggctaccccagccacgtggaaatgtaagttcattaaatctctttttttttttcataaattacccagtctcaggtatgtctttatcagcagtgtgaaatggactaatacagccacagaaaattatcttatacaagaatgtgtcttttctcagggtgtggcttatagtcaagaatatcaaagaccccggcctttcctgcaaattggaacaaggctaaacagtatccaaggtgtagagctccctatagaatcagcagagcttgcatttgcaagtgtattaatagatcagcttctccttctgcccaatcttgccttcctcactttttatttcagaaggacatttactagtacaatttctgcatctacttcttagtctcagaatttgtttccagagaacccaatcacaggcagagtttttgagtgattttctgcattgcactttcattccaatagttctgttgtaccctctcattaaataatggaagcgtctgactactgtatattcaagggcaaaggatcatcccgtgttttgcttgaagtggtacaaagaaaaacagaaaacacttgagctttgcaagacttctgcctcagaaagaagtaggtagacaagtgtaagctgggatgaatttaagatatggaaccatttactaggcaacctgggggtgactgaggagattaacttgtggtcaaaaacaaggattctttcagtaacagttgatgagcacttgggcaattgtaatttgacacaaaggaaatcaagacttccaaggccagtaaattatgacatccacaggatatctttatttatatccatacatttgcaaaattgagatttttctgcatataaaaccttatgcattgctttatttaacttctaaaaatattttaggttataaaataattttcagagtatagcttttgatgattgcataattttccatgctggagatatactgtaaattatttaccctacttctctattttttgatatttatatggttttatttttttctattataaataatactgagttgactatcattacacataaatcttaatgtgtatttctgattactttcttgggataaacctatcgaagtggatttaatgactattttcagtaataaaaagaaagattattttgaaagcttgtgatacatattgcagaaccttgatctgtaagtgtgaaatatgcactccttccagcctttcaatcagtatatgtttattgacttgtacgatgtaagcagaactctttttagatgttagagaaaagaaacaggtagagtcttgttctcagggttttcatgttcaatacaacacaacacaaagttttgtgtatgtgtatacataatgtgcaattgcctatgtaagtcctcattattttatcaactgtagcaggcatgatttaaagtattttttttaattttctggcatgctaacaacaaaaagtttatcaaggaaacatcattttcttgcaaagcaaggacagtatatttgatatgagctttttaccctgctctgataagaacatagaagatatgttgctattgaactttcttctccacatatatttttagttactttttatttcatattctgcagttacacttcctatacttcagcatcagtttatattcaactacatctcaaacttgaaatccttacacttccttcagaatcttcttacaaattcctttcctgtctttctaagttatatgtaccctccaggttttcacctcataaaagggtaaagaaaaaaaaaatagaaagcaacatcttttgtttttacagcataaggagttcagctcctggcagttcttctgccagcataacagttgatgaacactggacagcctgtttcaagtgagatgtaaaagaatcaagactgtatcttaactgttgtatctgattcttttaataattttcacccaagtgaagggcatgtttgcagcagttatttgcatgagccgcatcatcagcaccccgaacattagcatcctgggcattactgaagactcttggtcctttccctgacgaacgatggtgcatggcatgatctactttttctataaagcctggaatgacatagctgtggcaaacactctaggaggaaaatataaatgtccttcttttctgatattctcattttcatcgagtaataaaggaagtggaaaggtagaagatacatgcaaaatcataaaagtaattctaattcacaagataatctatcattttcaagcaagtggaatataaatactgtaggttttagagatatttagccccaaataaaaccacaggtctacacatgagtcactgtagcactttaacctctctgggctctatttccttctctttaaaatgcacagagggtttttgtgaaatcagtttagattatgcatatgccatttctaaaatagtgccttctctactgtagttgttgaataaaaaagtaacaatattagagaaacaattttagatttttctttcagtaaataagcttacaaataaaatatctactttggcttttatgataaactttggtttgaaattatctgaaaagaaatccttagtgttctcatgtactactcttattcctgtccatgaccgttttgaacagtgaaagaggtcaatattttctaaagagcctatgttttgacgactgtatatttgcttggcaatgttttatgaaataaataattagtaatggttttagctatattttaggtactcactacaatactttttttgttctacatttttctaaataccaaataaagaattagaaaatcattcaattataggatgtgaccttatcttgctgattacaccaaatccaaagtcaattttagcctctctttcagaggttgtaaatagaaacccaaattggataacacatttccccttcaagacaaacaggtggagcccatcattgaaagtaaattatcaggtgaggactcaagggacccgggccagttcagattctgtccagtcattaaactttttagatctcactgtcttcatttgtcaaaggcagatagcgaccctgacttcactgatacacagagttatcatgaaggctgcctggtacaatgggcagaaatatgctctaacaaagagatgtaaatgcagtatgtatagcattgagacttcttagaagggagctcgctgctgccaatgctctgctatgagttgcctcaggttgtacaattcctggtgaaggcctagaatttaagccattgaataggaggattatttgggaacgatataaaattggagataggttaatctagggtcaaatataggtgagaagcaaggaaataatactgtggtaagaaaatagattaagcagagaaagattctatgattctgactgaaataagcattgctaactataactggtttttgtgccccttggagcatgaggttttgaagagctcattgtgttggactgcctctttggagaaaccatcaatggaccttcaatctcatcaatggaaattttacccaaaaacacaaccttgatgcttcagaagagaggaggagggaaggatcatgtgcccatgagttttacccctttgatacgcagtagagtattgtttggcttacaaagtatttgggggaagatatgagcaagtaagaatataagtgcctcatctctcagatagatatgatttgaggcattagttgacatcctacagaagaaatattttttaaaaagtccagcttcaactactggacccatcatttatcagctatttgactttgggaaagcaacttatttttctaaactttatctctgaaatgaaattaaggatactgtatttgttatggttctccagataaacagcagatagatagatagatagaaagatagatagatagatagatagatagatagattgatagatagatagatagatgagcaggagagattttaaggaataggttgaaaagattacagaggctgacaagtctgaaatttataggccaaactggcagcctgaaaattcaggtaagagttgatattgatgtcatagtttttagtgcgaaatttgtagggcaggtcagcaggttggaaactcaggtgagatttctgtgttatagtcttgaaacagaatttcttatttttcatgaaacctgagtttttgaactgaaggccttcaattgattggatgaggcccaccctgcagcagatgttgcagggtaatctggcctattaaaactcagctgaccatagtattaatcacatccaacaatacctgtatagcaacatcgacaccagtgtttgatcgtacaactgagcatcatagtctagccaagttgacacatagagtcaaacatcacagatacttacctgtggttcagtgggataatggtctgaacacttagcaaggaagttgagatgatttcctgtgtcagcattttatttaagtggctgagggtgtgggagtggcaggggatatatttcaaatatatcaagcctaaaatatcttcttgttgactagataggaatatgtgttactttaatacatacaactttactttatcttaaagatattgatgattcaggtcaaggacccagcaaaaacaatgttgtgtagaaagaaagagcacaaaatttgagtgtgtgagaactgggtttgaatctaagttatatcctctctatcactttgggaaatctactcttgtcttcaatttccttatctgtcaaatgaatttaataacaccacttctttgagtttgggggatgtgtgaaacacatgaaacatagagtttctcagaaaatgtagtctaatatttgtaatgatcttttttcttcatttactgttttttcaacctgctgagtagaagctcatttttccatctgagaaatacattttcaaattccacaactttcttgtcatttatggttactaaaatcagttgaggtagtttataaatccaatcccatatcaattgtaaaatctttgtctccttctttattggacaaaactgagggtcagagacttggaatggagtttgtgcatggctttttctttcgcttctttttcttcccacttttggatcttgtttcttcaagtttgggacaagtgaagatctatcatgagatggtaatggtcatatgcctcttgggctgcttctgtgatgcagaagtgctcctggcctgttcctgatgttccctgatatgtgaggcaatctgcagatatgttggtttctgtatggtgtgtatgcttttcttggagaggtgtccagatttccacagcatgcctcttattgatgacccacttttagagacaaatgtgtttctttattggttgcccccatcaaaaatccatacctccaacctctttctagctgcagacactgaggctattgaggtattcttccttccatatcttctgggagctttagggatgtggagtggggagatgcattttttcatactggttagggctactcttgcaattctgccatattcagataacatgtggcagaaacaggcagacctctttaattacattccaaggggcacaggcaccaagttccccaggaactctttcaccctgcagtgctcctgtggaagcaataagagggtagcccggcagatgtgtaatgcaatgaacatgacctggtaagccaaaattcaagctctctttctttcaggaatatccacctgacttgcttaaagctctcatccccaccattccttgtcttcggggatgtgatggtgatggaagggaatcacagggcaagagcatagggaaagtattttgcactatgagtattctattccctaaaagaaagaagatgtttaaaaattacctctgtatttcccctctttcgttctttagccatccatcctatactccaggatgacaagttatccagtgccctgggagctgtatctgaccccatttgatggtcactctcttctgaatacaggctttaattgtcaattacaaggcaactaaaaaaagtttcattccatatcctaatacagtagctattattattatcagcaggaacagtagctcctttattcacactgagctcgtagcactctgtttttctcctttatgaccattgtataatggatgctttctggatggtggcatattgggccgtaaatactgtaacttcctcctacatagattaccagttagagctcctttacaatcattttatggttttaaatatagcgccatacttgcttcaagatcttgtttcctgtttcacaaagagcgattggtcttcctcgtgctgagaaaaaataacatttgaaatgcagaatccagcctgttccccagggctggctttccaccaggttcctgtggggaggtcaagcaggtatttcagcagggcagtgtcatgttgctccatatcctggccacatctccctttagactccacatcccaatatctgctgttcaattccctgggtaattaattaccctacaggagccaatagaatcctgtataagctggtgggattccattgtatgagatgaaatgcagcactgccttggggggtgctcttttcattaggcccatgctattctgtcttagttgaacacaatctataggtatctcttaattagaaccccaaaagcactgacagtgacgtcctttggataggcctgtagtaagtgaactaagcggtgtccacctgaggccaaacataatctcccctctccttcaaggtaaacttctataaaatagaaaacaaagaaactggattttgatgaatctgaaatgaatccctcttcatatatttattactcgtatataggaggttttcttttatactttttgaggattccccaaaacaaaactgcacttgtatagctaggaggactagggaacaatgcagacgtgggagaaagggtgagttcttgtgacccagaactgggtttgaagcagcaacttccgttcaatcaagcatgcctctcagcattgcaggtgccaagttgccattctctctctttccttccatgcgctcaggtttcccagctctcgactgctttttttctgacacctttttttatttcttcctctccacaggtctctcagttttgctgataaagatatttcactctaccccagtttctttattttgcattccgcatctattccttaaaactgttttctgaagtggcaaatacttttgtttttgaggatgaagattttggtttttttcatgctcactaaagtaaagcagatcttgttgccaggattctccctcctctgaagacagtgggttataacaagtgacaaatattttcttcctgtctcatagtaatattcaaaataagagatttattgtgtctactcagtgtgaggcaagacagtttataatttaccatttatttgagttgtgtgcagaaacctacgttaactcacaccatatttcttatttatttgattgatatttcagcaccccttgtagattgatgcctccagcagatactcagaagttcagctcattactatgtgtctgggccactctgaccctgagctctacttagcctactcatctctacgcatagtgctcagagcaaataaaaatggatttgaccattacagaagtctcagatcaatgcaaagacacagtttttactctgagcttggctctcttctacttttacttggtttttagccttgatttcatttgtggttggtcctgaggttgctcctcagatttcatgaaacagtttaacttcctagtttggaccccaagatccccttaagacactctctatagtaaagtccatgggggcagaaatcatagattggaatcataggtcagccacttgctagctttgcgatcttgggagattcacctggcatctcagagtcaggcttctcatcagtaaaattggggcaatttagagacatttgttacaaggattaaattagagaagcagttaaattgctttagcacaatatgagtaacatggcaatgtttaatacatattatttgcaattataatttcatcagtttattagtaaaattatatctcattattgccatttctagcaatcacccagtctttctcatcactgggctctcacccaggcatttgcagtcctggaatccatggaaaagctcaccctcatccctggtgacaggcatgttggacagctactttccagcatattatcacttgagaactatcacttgagagtcccctgctcagaaagatctcttcagatgccattttgcattaactgtcagaggctttataatccttaaaacagtcttgctacatgctatgagatatattttagacatattttctcatttgatacatacaaactgtgtaagattttgttttcatactataaagaaaccaaacttcaataggattaaataacatatctatgggttatggaactagtattaaaatctgttcgtgataactccctagacatggtgctaccattatagcatgagctatagtgagtgaagatttaggctggagagtggtggggcagaggctgcaatatgcttcacttaagggtcctcggaacgagtcaggaccaagtaaacagcttggctgaagctcaggctttcttgtagatggagaatttttttaaggagaagtgcatttcatgaattttcaagcagaagcaatatatgtaggcagtacgaagcatttcttaaggacccaaagcaagtggatgagaattggagattgatccatcatacactagctggtttggtcttaggacattgcttagactctcaaaaactcagtatcataaataaaattaggaaaatagtagtacttatcccataagaatattttgagaattaaatgagttaacaaatataaatcatttagtacattatctggtgcatagtaagcaccgaagctattgtcatttagctctcattaattcaagacacaaatataaagcttaagcatataataatgtcttgagagatacgacatttgactataactatcattttgaagttgtcataccaaggataaatacagcagaccctggaacaacatagatttgggctgtgcaggtccatttacacaaagattttcttccacgtctgccaccttgagacagcagtgccaacccctcctctttctccttcccctcaccctactcaatgtgaagaggatgacgacctttatgatggtacacttccacttaataaataataaatatattttctcttccttatgattttcttaataacattttcttttctctatattattataagaaaacagtgtgtaatacacataacataaaacttatgttttaatttactgttgaaattattggtagttaatggtggggcaagttagtgtccaaccccaatgttgttccagggacaactgtgtttgatgtaatataatgtttttgtcttaagagctcattagaaattatcttttttcactttccaattggaaagtatttttttaaatctcatgacaatatatgaatttgtcagtttgagctctgtttccagaaaatgagcatctttgattttatgatatttgaaattattgctctgtgtgtgcacatatatacatgtaatttataactaaatgaccttcttttgttttcatttgtgtgtatccctttgctagggctgctgtaacaaagtaccacacactgggtggattaagcaagagcaacatagtgtttcacagttctgggggctgggagtctgagatcaagaagttggcagggccatgcttcctgtgaaggacctagggcaggaactgttccaggcctctctcctagcttcttctggtggtttcctggcaatctttaatattccctggcttgtagatgcatcaccccaatctctgctttcatgtttttgaggtattcttcctttgtgcatgcttgtttccaaatttcctcttcttctcagggcaccagtcatattagggtaggggccaccacactccaggatgacctcattttaactaattccattccaacaaccctattgtcaaataaagtcactttctgtggcacttgggattagaacttcaatatatgaattttcagggtgtggggacaccattcgactcatgcacatgatcttcatttatttcacatctatacattatatataattatttattttatgtatgttatatatcatatgtatatatcacatgcatacatgcatttccttaccatcacattacagtctactagattatgtccttaagtgtcatgcttttgcctttattcattaataattatatccccagtttgtcagtactcagtgctgtatctgtcacactgtaccaatgcagcaaatgttgttgtgaatacacaaaattctagagaaaatagaaagggtgacaaatagttatgaataggtatgggaacgaatgggtataaggattgtgtagaaagatgtggggaataaatactcacacctgcctagtttgggcaattgtacctaaagacaacaattctgctggcttctctgtgactggtagggtaagccctaagcacatgttcctgcagtgtaagggggatattggggaaggcctccggtttcaaattccctttgctttatgctctgcaagttagcgcacatcagttcactagtttgaatgagattccaagcagccttctgacagcttcccagttagggtcagtcccttttggatcctatcaatgatggctactccatggtacctggagagggcttgctctgaaccactcaatcaaccaccatgtgtcacactaccctcattgacaaatccactctcattccatatttgggattatacaattttaggaattcttattcctctctttgtaaagtcaaagatttatttataaattatctgcaaagcattcctcagcaagcatgtcctttttgcaatgctgtagcataacctactcggtcaagttcaatttaacattttgtgccatcattttcttagcttgaaaatgtcagccattttctacacaaacttggcattcttctggttcaacacttctgtgagcttaaggcaattactgcagctgtgttactttattcaaatgtagcatacaactcaagccaaagatgttcctggtggacaaggtctcctatgacactttacctataaattatcatattcttcacttacaaaccttacacttatattactattttaaagtactaaatattttcaaatcctattttttaaataaacccaaagacaggactataaaatgctatggaaagggagaaaagaacacttaataacaagcagatgtcctcactgtatcctattctcttggtatttccttttacatatgtcatcttatttattcattaaaacaaccatgcaggctgggtgcagtggctcacgcctgtaatcccagcactttgggaggctgaggtgggtggatcacaatgtcagtagttcgagaccagcctggccaacatggtgaaaccccatctcttctaaaaatacaaaaattacccggacccggtggcatatgcctgtaatcccagctacttggaaggctgaggcaggagaatctcttaaacccaggaggtggaggttgtggtgagccgagattgtgccattgcacttcaccctgggtgacagagtgtgactctgtcaaaaaaaaaaaaaaaagcaaattaagtgttacagagcaagaaattgagtatcagataggacaaaattaatgtcccttggattcacaactacagggcagagatgggattaaaatccacaagcaaaagccatctaagcttcgttgcattataccacagttaggagtatttcattctgagtttgaatggaatatggtaaatattgttaaacacaggtaatacatgaacgatctgcaattttagaggacgttttaataaactacctaaggacctacagccctacagccaggccgtggtagactcaaggccaatatttgcctaccaattaaaataaaatcaattcaatgtgtattgttaatagctcaaaatttccatttaacacagcttttactattcatatataaaggtgaaattgtgtttgataaaattgtctttatatctcttaatagaaagatgatttgtttttcctattatagctagtgctgaaatcaggcctattaacaaaaatgagctgcagtcacagttttagtaaataatacactctcttgaatgtactttgagaggaaatatatttggaaaacagccctttatcatttctgacatgatgtaaacatgtcaccactctcaacttgtgcacttggctccaatttctgagagcatttcattctttttttaaaaattggttacataaaagtaaagtaccttgatttatgcttggtttaattagagagaaaatgaaagaggcagattgacaaggaaagaaagttattggagtagctggaccaggaggggcagatgccacatttgcttgaggccactggggagaatgaacccccaactcaggtctaagcagtactttttccatttgtaggaaaaaaaaaacaaaggagcaaaccaaaagttagcaagttgtgagggactctctgggctctgagattggaagtaggttgcagcaggaaggaactcgctaagcgccctagtctctgcatgtatttgggacacacatctcccttcttggttagaacattgctatctcagctgactcttctatctgcttttcccttgaattctaaactttgtgtttctggcgtttatatgtagtagttaaaataatgaggtcgaagccagtgttctgctgcaaatcttgactatcctacttccaagctttatgagctttggtaagtcacttcgcacctctaagcactagtttcttcatcagtaaaatgggcgtaataatggctacctactcatgacttagtacattaagatactgacaaacttcatttgtagcaattgttaaagatatttctaatgacaacataatgcctgctgcagtgaaaattcaagatgaatccctcagctgagtgctgtgctgctgaggaagatcacacagccatcctaagtagcttcctagaaaagtgtaatataagccaaaactggcactcagtatcatcaggatatcttctgtgtttttctagaaaaatcagtttatattctcaaaataaatactgtattatgactgtcttcacaaaactgctgtactactcctcctggctctactctcaagtatgacattgttcaaatgatattgagagaatagaaatccatacacactatctttctcattttcctgttaccaactggtaagtctccctgctcctcagcctttctttcttaatccctactacaaaataggaattgttcattcccctatcaaaggtcagtttttccatcaagggcctgtgtctcacaccttcctgctctgttgggttatcctctttctcctgaaacatatgcatgcatatttctgttggataattttcaataggacaaagacatgctctggtaccattaatatttaaaatgaaaaactccagtgtggtatccaggagaaaagtaaataaataataaataaaattttaaaaaacacaaaacaacccattctctttttccttcattcccatttgattactgttttatgtttttgctttaaattcagagaaattttttccaaagaggtttaatcttcctgctatccattccctactaaaccaattccaacagtcttcttcttgcctcactccatttgttcgtttatgtagcgaatgaacaggctaaatctatgctaggctttagagctgcaatagtaagcgagacaccgattcttcatggcaattatatagtctagaattaaaaaggattttaaaaagtgatcacatataatcttttattatagaagatatttacaggacagaaaccattaataaatatagatagtgaccgaggttcacctggagaagactgtagggcctgtgggaaaagctcactggaatccttctggcacagggaagtgaagttctgggtttggttccaggtctctgtggaacgtagggacagacactttaggtaatgtggatcttttcaaaaacagaaaatattaacagtttaataaaaaagaggacctagtcaagagcagaagaaacagtattcaaggaagggcaaatgagcatatgccaagacctgatggaggaaagtttgaacgatcaggaattatgaccaagacacttaataataatttggaatggaagagtgaagacaaaaaattagttgagaatatttaatgctttctttttttaagaaatagtcctacttattaggctttctgctgtggtggtgaaagcagagatggaggtgtatacctggaagagatttcatttttctagataattatagaagctaaatcatgagctcatcactctagttttttgtatgtttgaaaattttcataattcttaaaaattattttgtacaaaatcatcatgtaaattttgaaatacctctgagatatccaagaggaaacatctcatagaagcactatgtatattcactaatgtttcacggtgatacaatgatgagagacttacatttgtaaattatatttactggaatgttttcgatcacctcgggaggttgtgttgggagaagagagacaagtaaagcaagactgaattctgaggaatactgtacagacattctgcaaagaagactctgggttaaaacagctggtgaggtcagaggaaacagatatacgtgtgtttatgaataaagacaggagaagaaggtgctttaaaaagaaagcacatttcagcagtgttgacttttgcaatgaggttatgatgaagctgaaaaatacgcactgagtcagtcaccatcgttgtcttggggactccatgttaaaaaaattcttttggtcagggtagtaacactccctttgcctggcttagaatttagttcatcgcttctttactgttccaaatgtccacatttgcagatgaatatgaggttatagcaattcttccatagtaagataagaccaatatcattgctctcttctatagctacataaagtgtaggtaccagggccctaacttgagtataagttgtgaagaatatgaaaactgaggtccacatagataaacccgaatggcctatgggaaaagcccatgaaacctcctggcacagaaaagtgaggtttccaggttaagttccagatttttgttgaaaataatgacaatttttattgtctttgttgaagataagtccagtagaggaaattctactcaggctgtctcatagtaagtgattctagcacagaaaatagcacagtgcctagctcacagaatatgatcaataaaaaatatgtagtgactgatgcttgctggtaattaatcctcagttgcaattaaaacacacaacaacttcatcaagtatttacccatcgtaattttttgggcctggaaatggagacttttgagaggctaatgacacatccaacatctcatagttactagcagatttcatgttctaaacaaattgttctgacctgtcaggcaacaaggaggtagtaaattagccttaagatcattatgttacttgagtgtcatacatgtactggtatatttctcattgtattgaagtttgtttcttttttttcttcatctccaaatgtcctctgattgctattgtttccgtagctgagtcacgcctgagacatctcactgactttctttcctaactacttgatagtctaatgaaaggaaagagagggaggtgaagaaatagaataagataaattagtaacttctggacaattctggaaaactgaaactataggattaatgttcagagcgaagtacaataaatggaccataagtcaaatatttcataataattctgtagaaagtgacatttgaaaactcaaattgtacaaaaccaaatctttccttcatgatggcaaagggatgggtcacaccttaaatttcttcccagtctccatgctatagccacactctatggggaaaaatagccggggggggcgggggtcattccattacttgaaatgaaagacaccattctaaagaaatttcaaatttctttacattattaatacattattaaccctatacatgtttagcaatatctttctcaaagttagtaaaaggaatgcaccattattttgtgagaggggctgtggaaaacagttcttgcttattggacatatctgatggggagaggtcagaggtgttaatgtaaccagagcatgtgcttctcttatacagtgggatccacgagggggatagatgactggttgtctggtgaatgcagtgttacttttattaggccataaaaaggaaagtttcaaggccaactaattgtattgtttgtcatagcagtgtccctgtaaaaggagcatattttccaacctcggcctgggaagatgcaacatgaactgtcactaaaattaaggaaacatctctaaatcaaactaatttagactaaatttagactacatttagtcatcaggtagtttatggtgaccccattctctgcatgtgctgaaaaactatggctgtccatctctcatagcctgggcaggtttgcacaaaatgtatttgtgctagaaatccagaaaaacaaactaccacacaccagcataaaaattgaagctcagaaaagtgaattgaagtcctcagagcatcagttttcttactggttgtatccattttctggacttgccataaaagttgccacaaacttggtggcttaaaatcagaggaatgtgtcgtcttaatggtttttgaggccagaagtccaaaatcaaagtgtcatcagagtcacactctctccgaaggctctaggggagaatccttccttgctcctcttggctttgggtggctcctgagagtcctcagctgtgacagcctcactccagtctatgcctccattttcacgtgtccctctttcctgtgtctgtgtgtccactcctattcttataaggactccatttattaaatttaggggccaccctaaatctagagtgatttcatttcaagatatttaactaattaaatttgcaaagaccctatttccaaataaggtcaggttctcaggttctgagtgaacatgtattttgggactattcaatccactacacccgtagattgagctggcagttcttaacttataagacttattgtgactgaataacttttctgtaaagtatttggtagctaataggtgatcaacaaattctttgtttttaagaataccactatagttatctttaatcctgaccatgactgtctgaatattctcattttcttaaatatattagtatgttcaattcttacactggtctaggcattcattatggaagcaacctgctatatgtaaataagcatgattttaatcctatctagtaggctgtgtgttataaatgatccctagaaacatagacattccgttgtgggagcacggaaaagggagtgatgatttctgagaagatatgacttgtaactttccaataacacttttctagaagggtctcatgttaaaataaataaatgtcaaactaaactaagagacagcactataatgtactaattggctcccagattagggctcttaaccatcaggctattctgcctcccaaattaaaattggtagcgggacatgaatttattgtttgaaatgagcacaggttaagtaaaatgagaactatggaaaaacaatgacaggaagaacgggagaattatactttgctaacagtaatagtaaatagtgaacatttattgtaaataagtttaacaatacgcatttaagacaaatttaagagcttatattttttgaccagtaattccttatttaagaatctaactttggaaatcatacaggatttgtagaacctttttacagaaagatactcattctggaaatatttttaacactgagatttggaaacaatataatgcccaacctcaaaggattaataaattaaattgtgatattatcctcaattgaatactatgtggtcattataattcatgtttcaaaagagtataataaaataggagagtcctgggcttttactctgagtgatgttggaagccattgaaggtggaggagaaagaaatgagaagaacgtttccaaacaatgaagatgtccagccagtcattgacaaaaatgttctgttaatcatggtggatgggaagtaggactagattgcagctctgtatagatcagtgtgcagaggctcgcattgtgaattttagctccaggttgactgcaagaacaagccagcaatcccgagagtacccacagactctctgaaggaagcgaactgtttctgcagtacccaagagacaccacaaatactgtcagtgccccgacgctggaagtggtaaagggagacccccctctctggaacacacagccccactggagaaactgaaggtctctttgtgggagaagtttcctaccttctctggagttgaatccatttagagagctgagcaaaatacagggtttgaggaagcagtagaaaggccctgggagctcactgggtgcccaaacaggccattcctgcttggcaccacagggatccattgtgagggtggccagaggagcaggtgttgaaactccacaggaagaaagaaatctatagttgaactttgtaacaatttgaacagggcgagaagcctcctggccagaactcatgggagggcacaaatctgttgtgcagactccacaggcaggggaagaaccaagccctttttttccatagttgagaggcaggtagcctgaggcaagttttcaagcccatcttgcccaccacctggaaacaggctccatgagaactgctctttggtttgcatgggagctgggtgaggcctatgactgccggctttcccccacttccctgacaacctgcatgactcagcagaggcagcataatcctcctatgtacacaactccattaacctgggcatctcacccctatcccccacaacagccacagaaagacccacacaaggagagtcagagctcagacacacctagccccacccccaactaatggcccctccctatccaccgtggtaaccgaagacaaagggcatataaccttgggagttctaggacccccaacccccaccactggtccctatacatactactacagctgatactccctggagctgattcctcctggcaggaggccaaccatcacaaaactagagcattaaagctaagaaccctcacggagtccattgcactccccaccacctccactggaacaggaactggtatccatggctgagagaccaatagacggttcacatcacagtactccgtgcagacaacccccagtgccagcccggagctgagtagagtcactaggtggctagacccagaaaagagacaacaaacactgcaatttagctcacaggaagccacatctataggaaaaaggggagagtactacaacaagtaaacacacccatgggacaaaagaatctgaacaacagccttcagccctagaacttccctctgatagagcctacccaagtgagaaggaaccagaaaaccaaccctggtaatatgagaaaacatacctctttaacagcccccaaaatcaccctaattcaccagcaatggagacaaaccaagaagaaatccctgattaacctgaaaaagaatttaggaggttagttattaagctaatcagggaggcaccagagaagcgcaaagctcaatgcaagagaatccaaaaaatgatataaaagtgaagggaaaaatattcaaggaaatagatagcttaaagcaaaaacaataaaaaattcaggacactctgaacacactttcagaaatgcaaaatgctctggaaaatctcagcaatataattgaacaagtagaagaaagaaattcatagctcaaaaagaaggtcttcaaattaacccaatccaagaaagacaaagaaaaaataataagaaaatatgaaaaaagcctccaagaagtctgggattatgttaaatgaccaaaactaagaataattggtgttcctgaggaagaaggtaagactaaggaaagaatcttaagagctgtgaggcaggagcaccaggtaacctataaaggaaaacctatcagattagcagcagatttttcaacagaaaccctgcaagctagaagggattggggccctatcttcagcctcctcaaacaaaacactattcagccaagaattttgtatccaatgaaactatacatcacatatgaaggaaagatacagtctttttcagactaacaaatgctgagagaattcaccattaccaagccaccactacaataactgctaaaaggaaccctaaatcttgaaacaaatcctggaaacactcaaaacagaatatttttaaggaataaatcacacaggatctattacaaaaatactagctaaaaagcaaaaaaaaaaaaaccaaaatacacaggaaacaaagagtatgatgaatgcaatagtacctcgcatttcaatactaacattgaatgtatatggcataaatgctccacttagatatataaccgcagaatggaaaagaacttaccaaccaatcatctgctgccctcaggagactcacctaacacgtaaggattcacataaacctaagtacaggggtggaaagaggcatttcatgcaaatggacaccaaaagctagcaggggtagctattcttatatcagacaaatcaaactttaaagcaacagcagttaaaagagacaaagaaggacattaaaggccttgtccaaaaggaaaatatcacaatcctaaacatatatgcacctaacactggagctttcaaatttataaaacaattactaatagacctaagaaatgagatagacagcaacatagacaccaatagtggaggatttcaatactccactgacaacactagacaattcatcaagacagaaggccaaaaaagaaacaatggatttacactatgccatggaacaaatggacttaacagatatgtacagaacatttcatccaacaactgcagaatacacattctattcaatagcacatggaactttctccaagattcaccatatgataggccataaaacaagcctcaataaatgtaagaaaattgaaattatatcaagcaccctttcagactacagtggaataaaaccgggaatcaactctaaaaggaatcttcaaaaccatacaaatacatggaaattaaataacctgctcctgaatgagcactgagtcaaaaacaaaatcaagatggaaatttaaaaattcttcaacgtgaatggcaataatgacacaacctatcaaaacctctgggatacagaaaaggcagtgctaagaggaaagtttataaccgtaaatgcctacatcaaaaggtctataagagggccaggttcggtggctcatgcctgtgattgcagcactttgggaggccgaggtgggtggatcacctgaggtcaggagttcaagacgagcctgaccaatattgagaaactccgtctctactaaatatacaaaaaattagccaggcctggtggcacatgcctgtaatcccagctactcgggaggctgaagcaggagaatctcttgaacccaggaggcggaagttgaggtgagctgagattgcgccattgtactccagcctgggcaacaagattaaaaaaaaaaaaaaaagtctgaaagagaacaaacacacaatctaaggtcacaccacaaggaattagagaaataataacaaatcaaacccaaacccagcagaagaaaggaaataaccaggatcagagcagaactaaatgaaatggacacacacacacaaatatagaaggtaaatgaaacaaaatgctggttctttgaaaagataaataaaactgatagaccattagcaagattaaccaataaacgaaggcagaaagtccaaataacctcaataagaaaccaaacaggagacattacaactgacgtcactgaaatacaggatatcattcaaggctactatgaacacctttatgcatataaactagaaaacctagaagagatggataaatttctggaaaaatacaaccttcctagcttaaatcgggaagaattagatacccttaacagaccaataacaagcagcgagattgaaatagtaatttaaaaaatacaaacaacaacaacaaaaaaagtccaggaccagacggattcccagcagaattctaccagatattcaaagaagaattggtaccaatcctttgacactactttacaaaatacaaaaagaaggaaccctccctaattctttctatgaagctagcatcaccctaataccaaaaccaggaaaggacgtaatcaaaaaagaaaactacagaccaatattcttgatgaacctacatgctaaaatccttaacattatgctagctaactgaatccaacaacatatcaaaaagataattcaccatgatcaagtgggttttataccagggatgcagggatggtttaacatatgcaagtcaataaatgtgatgcaccacacaaacagaattaaatacaaaaatcacgtgaccatctcaatagctgtagaaaaaacattcaacaaaatccagcatccctttaatattaaaactctctcccagctactcgggaggctgagacaggagaatctcttgaacccgggaggcggaggttgcagtgagctgagattgcaccattgcattccagcctgggtgacaaaagctagactttatctaaaaaaaaaaaaaaaaaaaaaaaaaaaccagctctcagcaaaatcggcataccagggacatatcttaatgtaataaaagccatctatgataaacccacagccaacataatgctgaatgtggaaaagttgaaagcattccctctgagaagcagagcaagaaaaggatgcctactgtcaccactcctcttcaacatagtgctggaattgctagccagttcaatcagacaagagaaagaaataaagggcatcaaaattggtaaagaagaagtcaaactgtcactattttctgatgatatgattgtttaccttgaaaaccctaaagactcctccagaacactcctagaactgataaaggaattcagcaaagtttctggatacaagattaatgtacataaatcagtagctcttctatacaccaagagcaaccaagcagagaatcaaatcaataactcaacgctgtttataatacctgcgaaaacaaaaataaaatacttaaaagtatacctaaccgaggagcctaaagacctctacatggaaaactgcaaaacactgctgaaagaaatcatagacgacataaacaaatagaaacacatcccgtgctcatagatttgtagaagcagtattttgaaaatgaccatactgccaaaagcaatctacaaattaaatggaatgcccatcaaaataccaccatcattcttcacagaattagaataaacaattctaaaattcatatgaaaccaaaaaagagcccaaatagccaaagcaagactaagcaaaaagcacaaatctggaggcatcacactacctgatttcaaattctactataaggccgtagtcaccaaaacagcatggtactggtataaaaataggcacatagaccaatggaacagaatagagaacccagaaataaatccaaatacttactgccaactgaattttgacaaagcaaacaaaaatataaagtagggaaaggacacccttttcaacaaatgatgctgggataattggcaagccacaggtaggagaatgaatctggattctcatctctcaccttatacaaaaagcaactcaagatggattaaggacttaaatctaagacatgaaactataaaaattagaaaccaaaccctttagacattggcttaggcaaggatttcatgaccaagaacccaaaagcaaatgcaataaaaacaaagataaatagctgggacctaattacactaaagagtttttcatggcaaaaggaacagtcagcagagtaaacacacaacccacagagtgggagaaaatcttcacagtctatacacctgacaaaggactaatatccagaatctacaacaaactcaaatcagtaagaaaaaaacaatcccatcaaaaagtgggctaaggacacgaatagacaattcccaaaagaagatatacaaatggccaacaaacatatgaaaaaatgttcaatgtcaccaatgatcagggaaacaaaaatgaaaaccacaatgcgataccaccttactcctgcaagaatggccataataaaaaaaataaaaaaacaggagatgttggcatagatgcagtgatcagggaatgcttctatactgctggtgggaatataaactagtacagacactatggaaaacactgtggagatttcttaaagaattaaaagtagaactaccatttgatccagcaatcccactactgggtatctacccagaggaaaagaagtcattatgcgaaaaagatgcttgcacaagcatgcacaattcacagttgcaaaattgtgaaaccaacccaaatgcccaccaatcaacgagtgggtaaagaaactgtgatgtatatatatatataaaatatatatgtataaactgtgatatatatataaagaaatatatatgatggaatatatatatacatatatatatatatgatggaatatggtgaatatgatggaatactactcacccataaaaaggaatgaattaacagcatttgcagtgacctggatgagattggagactatgattctaagtgaagtaactcaggaatggaaaagcagacactgtatattctcactgatatataggagctatgctatgaggatgcaaaggcataagaataatacaatggactttgcggatttgaggggaagaattggggggaggtgagggataaaagactagaaatatggtgcagtgtgtatggcttgggtgatgggtgcaccaaaatctcacaaattaccactaaagaacttactcatgtaacgaaataccacctgtaccccaataatttatggaaaaataaataaataaaataggaaaaattactttcactctcaactatgtgtagcttagattgagtgtccctagaagaccctgagacaagaatttgtgcaagttgtttatttgagaaatgatagtaacaagcacagtaagagaggcaaagaagtgagacagacaagggaaagatgccactaaaaaatggtttaaaaaaaccccataaaacaaaacaacccccccaaaaaaggctatgttttttcccaaaaatatatcatgtttattgaggtataacatacagggttaaataaagggttttagtcccatatacacagtcacataaccacaatcaagatgtagtataatttcttcacttatcaaaatgtcccacattcttgctcctgatagtcaatcccccactccctggagaacactgatctgttctttgtccctctattcttgccttttccagaaagacatatatatggaattatacagtagccttttgagtctggcttcttcacttaataaaatgcatttaatattgaacaatgttgtcgcatgaatcatgttttcttttttaatttttaaattgttgagcaatattcccttgcatgaatgcactaccacagcagttgccattcatcagctgaaggacagttaggttgtttccagttcttggtgattatgaacacagctgctataaacattcatatggacataagttttcttttctcttgagtaactaactaggaatagtattgccaggacatatggtgggcatatgcctaaacttatcagaaactgctcagtgggcaactgggactcactcctcctggagacttcttgtagactgcacaaaactatgcttcacagtttttccattcaagggaccaggaagctgggggattcatttgtcctccaactctgccattagttgaaggttgctctcaagagtattaaccctagagcatctatggcccatctggtacagaatatgcatgttctaaaggacatagtaaaacctaggttagaagttgaagctgttttcagtaggaagccttggggttgatatgcacagaatgttgaggcctgccagcaccttctacatcatgtggggaaacatgttgccattcaaattctagtaataattatttttgtgggggtgtaaggctttaacaggaacatgactttcccttgtctcagaatcctcaaatataagaaatcttatgttagtatattttgtaaataatcacaataatactgattattaccgtgagagagtttatgaagcacttactatcagggaactatcattatctctgtttgcccagggtgatattgctaggagatagtgaagccactattcagttaagcagcctggtttcagaaaaggtacttctaaccactatgttatactatataatcctgttataacttaggttatgagaatttctacaaataaaaaaaagagaataaacaagagtttgtatataggtcactgaactgttcatatataataaaatagtaaacaaaatgtaatgttctacaaaatactgtgcttgtgtggtgggttgtagggattttgcttctgtttccttgttttggataaatttaatttaaagatcatgtgtttgtctatggaaaaatattgaaattttacttttttaatgtaaagaatgtgtgttttttaattaaaaaatttaaatggactattaataaattataattatatatatttatgaggtacacatatgtacaattataatttattgtatatatcatgttcacttatacatatgaggctaagacatatgtatacaaagtggaatgatcgactcaagctggttaacatatccatcacttcagatactattaaatgatggtgggaagaggtcaaaataacatggggaaaactgaaaactgaatcctgattctgcagttaagaagcagttgtaatggtgagatgtcaactgccaagagacaaaggcagagaagtattaaactctctgggtgctgtgttctttaagagcatctgtctttgctggaaagattgattctggcttgcaggcagtcattaccacagtgtccaacatcaaaaagcctccttgctctacccccagcagttcatcgattctggacaaccctgggtggtcttggactcttaccagcatctgcttagcctcgaagcccctccaaatctcactttgcctccacaggccacattaagttcaaattaacgaattcctctaggcagaactttttcaaagagttgaagccaaaataaaagttaatgaattccagcaaaggcaaaagacctctggatagatgttttgccctttttattcattgaactcatgcagtttttattttctcagttttctctgtgtaaaactctctgttccaccaatgtttccaaaattaattttgaccttctggcaacattttaatttcacatgccccagtagattctctttattcaacaacttatttcatatattcattattccttttagaaaatagcagtatcgtgctcaacataagtattcattatatgcctaattacactgagaactgtgcacagagacaagagcctggtgcagaggaaggagcacttgtctgaggggagccgacccagcctcatgcagggcggcgaggctgaagtgtaaccctgaggacagggggcgaggcaggagctgaggacagagagctgacttgggacgaggttgctcaatgccctgggtaacatgtgaaggagtttagattttattcctgagcgtggaagaaaaccatctcctcctctaattttaaaccttcttgagggcagggcatgtgtaattctgaatatctcttagtatcttctagtaagtgttgaggacaagttatcattaatagcaactacttatatattgtggctcagcaccttccaaataccctaacaacaccatccccaaatcttcacaaaacactaaaagttgctatcatttaattgaatgtatggatactcaaaaataagactcagagtagatgagttgcaactgctttgttgagtatctaacgtgaaagatgtagagagaagcaagaccattttatgaaattgtcactgtcccataatagattagagtaggttctaactccagcttttcccttctccatgcttgtgacttttgacaaatcagttttttacatatcaatgggcatttgttaaaaatctcctgagattgaggcatgatgcttggttctacgatggagaggcaacaaaaacagtctttactctcaaggggctcatggtcttgtagtagaattaaaatttacaagcaagtaatagtaaatcaatgtgaaaactacattaataaatgtatacaatttattaagggacaaattaactctacagggttttataataagctgacatgaaaatgactaatggtttgccaggcagaggagaatgagacagacattccaaaaaagaaagaatatccacaaatccatggatgtccaagtgtgagaagactggtccgcccagatcatgtgggcacttatagccttcaatcactgtcttcacctccagtctacagatgtgtggctgttaaaatgggttcctgggaaccccagacgtcctgccagtgttgcaaacataaccctgtgaggcccagcatttgcaagaccagcaaagagaggtgataagcagacaaaatccaggcctctcatcatattaactgtgtgacattgggtaagggtccaaatctctctgtgcctcagtttccaccatatgtgccattgggaaaataagagtaactatatcactaggttgttgaggagataaattatttgaatatatgtaatgtttttggaacaaggcctggtgtagagtaaatttcatgtaagtgttagctaattttatgatgctaatcacactttaaacagaaggaatcttctttacctattttataccttcagctttcatataagatatattttgaaaaagtgtttgcacaaaatctttctaaaaaattttaatataacccctataggtccattctttcaacaaatatgtaatgagtatctttttgttccaggcaatgtgctcgggatagggcagcaacacatttaacaaatacttctgccatcatgggctttcttctgaatggggtaaattaaaaagttatatatatatatatgtgtgtgtgtgtgtgtgtgtgagagagagagagagacattatattgtgttaaaatatctgagaaaaataataaaaatgttggagaaataatgctgtgagtggggtgttcaacaccaagtagggctgatagagaaggccttggtagaaggtgatgtctgggagaagtcacgaagcaggtgagggaaggagttagtagattcctgggcatggtgggagcaggccctgtgtgttgaggagctgccagaaggccaaggaaagcaggaacgaatgacatgaagaagcatcagggagggagggaccggtagccaaaggtgagaggctatacagattgaggtaacattggtaacttggaagactcagggttttattccttgaagatggggaagatgggaaattacaggagggtttggagcagaagcatgacatgggtgattaaggttttatgcaaatactaggctgtgagtggttggtgggagcataggggtatcccaaaggctaggaaataagttactcagcaattcacagaagagaccatggtggttttgatgagagtggtagcaataggagtagtgagaagtggtgaaattcttggtaaaatttccaaaggttatataaggttgtatatagtgagactgtggcagagtgtatccattaaaatcttttttgttgttgttgttgagacagaatctcgctctgtcacccagcctggagtgcagtgctgcaatcccggctcactgcaacctctgcctcgcgggttcaagcgattctcctgcctcagcctcctgagtagctgggattacaggcgtgtgccaccacgcccggctaatttttgtatttttagtagagatggagtttcaccatgttggccaggttggtctcgaactcctggcctcaggggagctgcccacctctgcctcccaaagtgctgggattacaggcgtaagccaccaagcccagcctaaaatcatttttaactgatgcctttggcgcttccatttctgggaaattgttcagtaggttcctgattacctagtcaagaaagggttatgggagcagagcagggtctggctcttattccaagcacaggtgcagcccaatggttttcctgtctttagacaagaatgcttagtaattcccttgcttaaattgttcctccatctctgtcattgaatagaatctgaccctgagtaatgtgacttaatgagggcagtttgactgtgcattcaaagaaccactaaatatatgtttactttatatttagtctcagccattatgcataattatatttaaaagggcactgaatagataagttacaagccacaacaggtgtgactggagaaacacagagaacgcacataaaatctgggagagagagcaggttacataaatttcccatcagggcagagaaatataaggtatatttgaactttgaagccaatcagtgtgcaaccaggtaattacaggcagcctacaccaggatgggagatgctggagtgtgagcttgggaatgcccccataactcattcatcttcaaagtgcccttgggggcccggcctcaccagccaggaaatccaggatcgtcagttggaattatatcaacatctgagaggccatggagggaatgaacctcatttaccatgattaaagcagatgaactgcaggtttagctcttctccattaaattcctgttaaacttgagaacttccacaggcattatcttattaataggcaggacagtcattaacaggtgatgaaaggagggaagaaatgactgtgaaatttctgagaatttaagaatgtctgcttcatgtacagttaagaaagaaactaacattcaacatttttatcaggaatttgcatgcattatttcattcatttctcatatcaaatctgttctttattggcatcaatctaaataaggatactgacggaaaattaatataaaaattattttaggcccacgttgaggattgaagcctgggaaatacctggaaatggcttcattcagccttcgttacaagcaggtttttagaagtgaaagggaataaagaatgtgctgatacaaagttttttgttaggaattttcaatggtttacagaaataacattgattagtgattggctatacattttagagctctgggttatgagttatggtgtccagcgtatggcattgttaggttaatttatggctacttgtcatcaagtaatccagagcccacccagcaagtggcttcaaaaggtgattacttagctcaaggttggggtggtggggaatgagacctcactgctgtctcaccttaatggcccttttcagattgctcagataatagtttcttctctttctcataaataaaggaagagagactgaaagaatcttagtaattttctagaggtggtattttctagattcagaatgaactacacaaatattgagtcccctgttatttccacactatcatttgtcctccaaaaggtgaaatgcattgtctgacatcatattttagtgacagagcctgtccttgtaccaaggtctcttgtggttttctctatagtctcatgccagctgcctagctatgggcccacagaatcaaagcctggagagttcctatgaagacctagataaccaggtttcaacatagctctgtctctggagtgagtggtgaaggaaggaggggagcagaccacgtagccgacttctctatttgcattttttacttattgttttgtagtgcaagcatcaaacactggaagcggctgagcatttttctctaagtatggcgaaagcttgccttttttcaggtcttcttcttctttctcattaaatcactttggtctcacacaacaaaatagtcttcagggatggccttaggcaaagctgtaaaatctatcctctgttcccagaacttctccttgtttgtcctctctctcattctgtgaatctctcatcctcttctgatacttaggaaatttctctcatacaagctcaaaaaaggatccagatcattgtatgcatgaaaacaaggcctcatttgcaattcaaagggcaggccaactgtgattatgcctcttatgtgttgtgaatccaatgaagaattttaataaaagttctaaattgaggcatagccacattctaaaagcaatggagaatgatttgtgggacatgaaaacgtgtcaccctttaccattgctttctttaacgttattcagttaagtcttaattctcaagtttctatatttgatttttttcaaattatgctccaacctatagactaaatggactctctgtggctgagatgctcaaggtaaagcagaaccaggcagccacagcaggatgagggggtcatcatgcatactgtgcgctcggaaaatgttgcaaaaatgtcacaagacatcccttcctgcaatcaagccaaactgaaataggctacagctggaaattcccaaacagaccaacaattgtccaccaagagtcagccaacaaagagagacctgtggttttacacttacaggtcatccattcaaggctctgttcctcactcccccaggccccttcctcggcctttcgctttttacctttataatctctaactctccaacccttcctgggagtgcactttcactttatcccaaaggctactcgtctccaatctataggtcactgtcagaaaataaagcccctttctgcctctgtagatctcatcttttgttaatagctttaatattctaaaaagaagattcacaaacacctagacccgtggctgaactaagtttaaaagacgattgattgagtgttgttttctggatccagttgaagtgtgttactcacctactgagctagtaagaattcccctaggaagaacagtaaaaatgaagaaaacctgagctccagagtcaacgtagctgtgataggctcaataatagcccctccacagttgtccacgtttgaatactaaaaacctgtgagcatattacctgacatggccaaagaggctttgcagatttgattaagttaaagatcttgaagtggggagaaaatcctagattatgtggatgagcccagtgtaattacaagagtccttataagaggaaagcagaagagtcagatcctgagaaagggagaggtgacgacagaggcaaagatcaaagaatcagagagacagacgtttcagatgtcatgctgctggctttgaaattggaagaaaggtttgcaagctaatacgtgcagcctctagaaaagacaagggaacacttttttccctagagcctccagaaagaaggctactccactgataccctgattttaggacttctgacctccagagctgtaaaagaataaatctacgttgttttaagtgactatatttgtgatcatttgctacaggagcagtaagaaactaatacagtggtcggtgaagatgatcttccctagtaatggttagtatttgaggcaattagactttgtagagttgcagctgttgtaggggaatattataagatcgtgttagaaaatacttcaggagaataaggtgaaaatgcccacggcgtgtaccagcaggctccaaagcctttgaaaacagaaatggtagcagtaaacaaacggcacttcttggagtaaatattagcgttctattaagggccttaagattgtaaattgtcacattccaccaaaatgctcttttttctccttctctttttaaaggtttgtccaatagaacataaaactgtgacgcttgaagataaacgtgaccttgaccagccctgaggtgagcagtgatttctttcaggtgtcaatcctcagcaaatgcaagagaaatattaacctgtggcaaaatgtgtgctggtgtgaaagagagaatgatgtttcctgaagaatctaacattttttctccatgtgtagaattcaatcaggcttatgatgagcaaaaaatgaaatagttcccttctctctgtagaagaaggtgatgattttttttttttgacttacagtgcatgcaacccagatttaaatccaggaagaaacaaaattttgtgttctataaaacattttggaaaaagaaaagtgctactgtaggtaacatgcacagtggtgtcctgggacccccaggtcaaatcctttgcatccactcctgtgttttgccacgccctcactccatcaaaagtctgccaccaccatcctcctaaatgctgtaaatgaaagtagcatagggtgccaagactcccaagatactctcctttacttgtccaatcattatcccaattccagctaaattccttaacgggcataactgcctaagtcaaatttaaatgtaaaaacttacatgtggccagtggcattttatcggacagcactgatctaaacaaatatctgggattggttttctcaccttgttcactgggttggaggagatggtgaagaacagcctcaaatctcccaggacggacattattttcagaaagggggcagatggagggggaaggaacagctcgtctatcattctttctctcctacagtaattatgccaagatacaaagttataatttcttagagttcaacaggagtccaaagactcctggtctttctttgtgtgagccagttgatttgcatcctttccaggctacataaacacagaagcccacagggcaatccagctgtgtgtattacctgagccgtggggagggatgctgtgtgatcaccattacctgtgagaaacttgccttactatcttcttcctactgtttttgctgtacttacccagcagttgccaattagatgggcctcacaagagtaaaaatcgtcaggtcaactgtggttacaacaagaatccttgcatggagatgccataattttagacgcacctatcatggtggaggaaaggtgacctttgggatgattgtgtctcactgctttacagttgggaaagcaggtcaaaagacaataaattacttgtccaagatcccatggtaagattgttccagaagcacatacataagctgtctgtactacacctatcctgaaattgtgctctctctgcaaggccattttctctagcaatttgcaagaactgtaggaatgttcttgctcaaatatgaagcatggacgttctttttattgccctcaaaataaaatttttctttatatcttctgttactaccactgaacaaatgttttccacctactcccaaagtaaaggaagataaaaagagaagttagaaataattgcattacaactaccactattatgactactatcatttccgctaatgctacatgagaaattctttctataaagtacattatttaattatattaacagccctatgtggtaggtattgttatccccaatagtcccccaaaagaagcaaagaaacagaaaaattaagtaatttatataagttcccagagcaggtaagtagtgatgttggggtttgatccctaaggtaagtattcccaaagctcgttattttccaataatgtgtttgaatatgttaaataccttcacttcagatctctcccttctttcccatcctcattctaattttgtagagtattggtccgtctttgaatatatagaaaaacagttcttattaatattttactaaatgtaatcaactgatgctatgtatttccagtttcaaatgagttgaacataattcctttaaaaagagtggcttgaaaagagtatcagaatgagtcaagtgacctgcatttctcttccgagctctattccaaacaaatcacaagcaacaataggttgtttttgtacaatttcagaatttgtcaatatctgtggtctcagttgaatgtttctggaagccgaatcagacacacagcaatcaaaatcaccagggaatgctttttcagcattttatacctgcattctccaatcctctaatccccaagtaactacagaacatcaaggacagtgttggtgtggaatgtgacatgcacatttttaaaccagtctctaaggaattctaatttacacccttaacccctggaaaagataatcttcgagatttttaaaagcctattttaatagacttgtgagcacttcaagctctaagtcagaagataaaataatatatagaataagtgagcctttacaaagctcatttttaccaaattactgttcactttaccaagttaccctactgatatatttagatgagccattacacattcatgcctctgctcctctctgactagtcacctgtgccaggtgcactcacaggttttattgaagacttggaagtgctatatgaaattctgaaatgttctcaaagtgcctgtaaaatgttttctttttcctgaaagcaaagatttgtagaaaggtcacttaactgttttcttacagaaagttgatattcatgaatccataccagttctggatgaaataaacatcttgactgtcctattgagaagacatgatattggggtgaagtccaaggcatgtcttcagttttggctttatatttaaagttataaaccgcactcaaaacagaacaaaatatgtatatgtatttgagaagttgtaaatgtagtacaaagaataataataatgaaaacaaaaagcactttaggctctaattcaacattcgtggcatagtttataacagtgaaaattgaaaacatattaaatgctgaacagaagataagaaaactgtggtaaatccactagatggaatattatatagccatacacattacagttattacttctgtataataatataaaatatcttatatcataatagtaagcaataaaaacatgagaaaaaattttatttaccacttaaataaaattagcttgaattacatgtatgaaaaaagatcacttaattatggaaaataacataactaacaggaacataatcttaaggatgagtgttttgaattggttctggagtttctggaattgattctctaaattaattagatttaaagtcaccaatgactctatttccagcagtgaagagagcactgatagtctataatgtgatacagcaatagagatgggcaaagcatcaccattggctactcctaatcagatagctatgagaggccaggttctgggtgaccatatatataatactttctaatctttttgtcaaactgacagctgtaatgatattcactagttgctcctaattttgctagaggaaggaaaagaagagctcaggggttcaaattcccaactcaagaattatataaatgacctgaaaatttctaagtcttccctgcaggaaatctttatcttctatagctgcagatctgagattgctcaaaaatcaaacccagaatctcatcctgtgagaggctgaattataataccagttgaatttccaacctcacggggtgtttattgttaaactagggcattgatttgcaaggaatgggatcctgagagttggaatgaagaaataagagaaggccctgatgagattggggacactgatttcctcaactctgataagtcttctttgccagcaaaagctgttattccatccccatctgagtagatcaacctggctttgcctaaggaaactgtaatggcctcccctgaggcagttgctatgcaaattgtagacctataagtatactcaagtcccagcaggcccctaaaggtgaggtacagaatgtgacccatgaggaggtgtgccattctccaaaacaaacaaacaaacaaacaaacaaacaaacaaacaccttgatctttttcaatatatatagacagaaattttaggaatatatgtgggaatgaatatttatgtaaaatggcagaagaaacataaatttggacaaaacagacttatattgacatgagtccactaattagagattcttatttaaatgttgcagtttggagaattagaaggggactctaacagttagttgaagtggtaaactatattatggcccaaaaggtggtccaccgtgaataaaccagaatgacattctagtttaagtgttgcagtttggagaattagaagtgggctctaacagttagttcaactggtaaactaaattatagctcaaaaggtggtccactgtgaatgaaccaggtggtacccctgactgttcattttacgtggaaggagaaatagccagacatgtattatatattgcttcatggccatgaccaatggtttgcctgcatggtaaagtacttggaagaaacatgattggaaatgctggacctgatttggtatactgcaaaggaagacagtgaaggcttagggagatgggaatgttagttttttcacttacaacctactcacccacatcgggagggtccagcagacatagctttcatcaatactgtgagaaatacatttgtgagggagccttagcctccttgaacagctctgtgatcgctctcctctactgactagaactaacagtggaaactgatgtcactgatatgggaagcctaaatgcagtgagaacaattgcatctaggagtgtcaggggtcaagtggcagcactcaaccaacaaaaggtgggcatcgttgctgtaatggacagcagggatcaactctccagctctatgtcatagtagggttagcagggatcttggtcacctttctctttcagaatacatcacactgtttcactacattgatgacattaggcggattgtacctcgtgagcaagaagtagcaactacactagacatactggcattacttggagatattgtgggttccgttctagaccaacatataaaagcaaatatttcaataaaaggagtcacacaaatttttgggtttcccagtgcatataaaaattatatttactctttatcatcatctattaaatatgtaatagcattatgtctaaaaaacatacatacctaatgaaaaaatatttcattcctaaaacatgtccaaagtcacaaagtgagcacatgcttttagagaaatgacattgatagacttgcctgatgcagggttgccacaactcttgtatttgtaaaaagcacagtatttttcaaggtgcaataaagtacagcacaataagataaagtatgcctgtactggtaagacatttgcatgttagaggttcgtacataaattcagaggcctttccaaatcagcaaaatttctaggacttcagttgtatggagtatgttaagagatcccttctaaggtgaaggttaagttgttgtatcactcagtaaagaccctagactatcaaacccagatgagtaatatattgactccaaaattcagaaaggcccataataatgactagtgggactctttgaattttggagtcaatatatttctcatctgggtgtgatattctaggatcttaactgagtgacttgaaaatctgctagttttcagtgggtcccagaagaagagaagtctatacaatagatttaggttgccatgcaagctgctctgcccttgggtcatatgatgcagtagatccaatggtgtttgaagtaacagtggcatatatggatgccatttggtgtcatttacaggcccctataggtaagttttatagcaaagtcctgccatcctctgcagataaatactctccttttgagaaacagctttaccctgttattggagcttagttgagactgaatacttaactatgggcaaccaagttaccatgtgacctgagcttcccatcatgaagtggatattttctgagccaccaaaccttaaagttgggtatgcacaactgcactccatcatcaaatggaagtggtatagaccagatgggactcaagcaagccctgaaggcacaagtaacttacatgaagaaatggctcaaatacccatggtttctaatcctgctatgctgccccttctctctcctagccagcacccatggcttcatggggagctccctaaatttaggtgacagaggaagtgagaatgcatgccttgtttacagatggttctgcacaatatgcaggcaccatctggaagtggacagctgtaacactacagtcctcttctgaaatatccctgaagggcaatggtgaagggaaatcctctgagaaggtagaactttgagcaatatacctggttgttaattttgcttggaaggagaaatggccaaacatgtgattatatattgatgcatggtcatggccaatggcttgactgcatggtaaaggatttggagggaacatgattgaaaaataggtgatagagaaatttggaaaagaggtatatgaatatacctctctgaatgggcaaaaacgtgaagatatttgggtccagtgtgaatgctcatcaaagggtgacctcagcagaggagtatttttatcatcaaatggatagagtgaatcattctgtggataccagtcagcctcttttcattgtcattaaaccaatccacccctgtcgttactcaaaaagctcatgaaaaaagtggccatggtgacagaaatggaggttacgcatgagttcggcaacaggcacttctacttaccaaggccaacctgaccccagctgttgacaagtgcccaacctgccagcagcagagacctacactaagttcccagtatggcaccattccccacaattataggtcagctacttggtggcaggttacttacattggactacttacattattgaaagggcagcattttgtcctttctagaataaaagctttctctgcatgccaatttcttttgtttgcttgcaatgcttattcacagtgccctggtggttactattattaactttattctctaaacaaagaacataaggtacagagggtataaatcagctgccctttgctacctggatatggatagcaattttttcctttcttgtcaactcttcagcatctctcattaatctgtctcctcatgcaagaacagcactcttttcaattttgaaagtttatattgtgtttaatatcacctaggattaatcttccctcattactcttatttttcataacttttcaagccattcttgtagggttttaggatcctgtaagcattttgaaaacaaattttacttcagaaacatattggaaatgtactgcagaagcataaatttgtatgttaatagagatcatttaaatagttttcttctttaaatacaataaggcttcccatttgatgatgtctttgtttttgtgtgcctatgatcatcaatatcattttcaataccgaccctgtttcagtgcagacctcgtagataattcatgttgtttcccactacctccttctcactgatactcatgatgtgaatgtggtttttttctcccattatttcttttaaccacttaataagaaagttattaatttctatatgtttcatatatagcaactgtcctgagttttttgatcatttgaataaatttgctcatttgaatctagcaggtgtttcacgtataaggatatatctctgcaaatgatgactattctgccattgttttctaatttttgtatttctgttttgtgtgatagcatttacttgcaactgcaggaccaggtgaaataatagtggtgataatgaaaacccttgtcttcttcctgcctctaatgagaataattttaattcctccttgtaaagcctgaggggagcgtttgagtttgacatattaaatgtttattcacacacatgcatgtgtggataaagaagggacagtaatatctacctcatggggtgttgtgaagattaagagacataatgtatggaaagcacttagaacagtgcctacctcgtagcaaactctttacaatgatgaatttctatgttcatatgcaagagctatccagctgtttactctgtaaaaccgcagccataaatgggtgagttaatacacacaagacatttggaatggttcctggaacatagtaagggctcaagaaatgtctaagccattaatatactgcattattaaggcattttgtcaagaactgatgctgatttttatcaaaaggttatgctgaggtttttctacttttgatccatcagtcaaatgaattggtctggaatattttctagtgttaattcgtttgctttcgtggaattagctcgtcttgcacttacattaaatcagctgccagagtttgcaactatttcgtttacaaaatttttaaattaatactgaaataaaaatttgatcttagttttttttagttgagctttagtaggaacagttcgctaacttcacagaaattattggaatcttttcctaaatagaaaaataatacaatgcaagagtataaataaattatatatgtatatatctaatatttggctccctaagtatttagaaaatcaatatcttccttaaagagttagtgaaaatcccctgtgaaacaccctggcctgcttattgttttttgtcttattttattctttggtagaagtagcttttgacacttttaatgattttaattattttacttgctttatttgacagtttaggtttctacctctttaggttccctgcctcatctggagttagttttaatagtttatatattccataatgagcatacattgtattcttttcagtttatttctatggagttgaacaaagtgatgtcttgtgaatacaatattttcatctgtatcttcattaccttcctcccataaatttgtattgttttatttcactttgctttttattttttcattaactttggttaaattaggtaatggtttattttcccagagttttatgtatttttttcttttatttttaatttatcagtattatctccttcattataacttatatattttgtttttccttttcctgatttttttggatggggtggtatggaaaccagtagtttgcattcttttctatttactaagtataagactagccatgtttctctgaatattttcactgaaccactgattttagttgcatactattttatgctaatttatttttgcattttctgtaattttagttttaattttctctttgatcaaaacttgcttacaaaagagttttcatttatcgattggttaattttttaatatttaaattataaataagttttttattaacatatctcacggcagataaatcagataatgttttctgtattatttctgcttttaattgtttttgcttacagtgcttttatttttgcaaatgtttcagacatccatgaaaagaatatatattctatgattttagtcttagtggttgctatgtacatagttaaatgtgccttaataattagtttaattataacgatcttaagtgttttattaattagtttttttttaagtttttttcttgttctatactaaatcactcacaagctgtgaaggatgaattgaagtccccctctactaaaagaattctatttctatttggttttcttgccatgttactcattcctctcttaggttatgttattgtggttactgatttttttttaagtttaatattcaatttggattatccttgcttgcttaatatattgcctttcttggtctcatttaattctttatgtcctgaaatatttttaaaacacctttattgagatataattaatatacaaagaactgtgcatatttaaagtatacaatttacaaaaaaattaattaaaggaattcaaatagaaaataaataaataaaattatacctgtttgcagatgtcatgattctataaccagaaaactaaaaacaccacacatggacatgaaaagtgtttgagagaatacataaatacagttaagttttgggttacacagtaaacatataagaattagtgacattacactaacaacaagccatctgaaaaataaattgagaaaacaatcccatttatagtagcataaaatagagtcaaatacttaaaagtaaaccaaagatataaaatacttccatactgaaacatacagaacactgatgaaagagattagaggagacacaaacaaatggagaaacaattttgtgttaatggattggaagacttaatattgttaaaatgcccatactactccaaatattctagatattcaattctatctccaccaatcccaaatgctttatctatagcaaaagaaaacacaattttaaaatttatacggaaccacaaaagtcctagaatagccaaaacaatctttgggaaaaccaataaagctggagacattacacttcctgatttcagaatatattacaaagctgcagtgattaaaacaatataatactggcattaggacagacatttagatcaatggaagagaatagaaagttacagaaataaacccacatatatatggccaactgatctttgacaaggctgccgtcaatatacagtgctggggaaactagatatcaacatgcaaataaaaaaatctgactttttaatattgaaatgccctttctttttttgtttccctttagaaacaaaaagattttctatcattttcctttcaatctttcttaaacattttgcttatattttttgaaagaatatttgagttttgattttgtgacccaatctttttatttaaactattaattgtcactgattagcactttttcttctctggtttgtagatagttttgagtgtgataacattatattaattaaagctattctttctgattttggagcatttattttgttttatcttttactgtgctgtctgtgatggttttgccaggggagtttgcatatactgagctaattattacctttatgacaatgagtttgtatgtatcacatttgtctctctttctttacacattttctaatatatacttgccagagataatagaaaaacacatgtcaccactttgcctgcttctacctttgaaactcttcatctctaaattttagatgattatgttttttctgtatgtttaggcttatgcccttatgtactcaattattttatttctttaaagtaaattttttgacccctggctataaaatatggggaaatctcataaaatcttacaccttctctttcccatcatactcccattagttatacaatttttatcgcatcagagtttataattttcacatttatattgaagacataatgctgcatttgtttcagcttttattcttgagttaaatggcatcaaccctcagcactggcccttcatgacaatttctccaaccatctctctttttttttgttcaagtttattccatcattgtttccttaagaaggcgtcatttaaaatattttctctgttcttggaaattctaaacaatgcaacaatgtgtgtctgtcattttcattctcaaactactatatgccttgtataaaattcttgggacacttctgctcactaaggaatttaggcactcttctagtgttttccagcagtgctgcaaaagttagattaaaatattctttatttaatttaatgttcagtaactttattaggatatgtttcagggttaatcattatgtgtcatgttttccaggtctcaatatacttagtgatatctaaaaacaagattttttaatatctgagaaaaacattgaattacaccttaatttcctttgtttcttttctcctcttcagaaataactattttccttcaaaaacaagtattacaagaatctgtcttctatagctattattataatttcagttcagatcatatcttttcagttcttttatagcatatttttccttttgcttattttcttttattaattaattaattaattttttttgacagagtcttgctctgtcaaccaggctggagtgcagtggctcaatcttggcttactgcaacctctgcctccccagttcaagtgattctcatgcctcagcctcccgaacaactgggaataaggcaggtgtgtgccaccaagcccggctaatattttgggtttttagttgagatgggattttgctatgttggccaggctggtcttgaactcctggcctcaagtgatgcaaccatctctgcctcccaaagtgctgggattagaggcatgagacactgcagcaggccatttattttcttttttttagaaacaaagtctcattttgtcacccggactggagtacagtggcgtgatcatagtccactgcagcctgagatcaagtgatcctgtcaccttggccttcgaaaatactagaactacaggcatgagccatctttgcttacttttcttaatcccgtgctccatatagcatcctctgtttttctgtaacgtttatttcccctcatattgtttccaaggttacctttatttttgcattttgtattgatcttatttttatttcaccttttttttggttctgccactcatatttcaagtccttgtttcgcttcaccatttccctccttaaatgttgtttgtcagctttgactcattggttttttttgggagattactccattgatgtttttctttttccttttattttatggtaatggcaacagtttttatctattcaatgggaacattttttgggggaagtgtgtgtgtgtgtaaattataatatatttttatagacccagtgctaattttttttttttcattttgaatcaggtgatttttagtcaggctaacagatttttattctctatgcaagggagtccttagttaactgagtaatatggctgtaggctcatcacatccactgtgttctcactcccccaacaccttacccaaaggcggcttgctgtaggtccaagttgagtgtatgctgcctcctatgcccctacctcctgtgcttattgttggtaccaaacaggttccctggaagctctcactttcattctcattctttcaaaatgagctttttaagtgtggctcctgaacgtggtccattgactttgtcttctacaaagatgtgctttctacagactctggaccacctgggtggccgtgacagcactttcatcttgttcttcactgaattacatatcttgtgttttctagttttatgaaaaagtggctttacactgttgctttcattttttttctattgtttctatatcatatctgtgagagaattagggaaaactgactttagagttttaaaatcaggtggcctgttattcttgtaactatgttaccgtaatcatatttcaaaaaattggcatttccaaaatgataattaaacaaatattttttccatgaatttagcaatgtaatagcttcatggagatttggaggcaataagtggctcacttctttgaaaacttaccttacaccttgtcatgtgtagtgtgccaatttttataagagtgggagaaagaatcaactgcaaataaataaaaagaataaagagaagacatcaggtaatcatgaaacacctcctaccaactttataaaattaatcaggaaagaaggaaggacaagaaacaaaactgaacacagcttgcagcacattcagcattgatcaccaggtcagctgctctccgacctacttcctcatagttgtttcatgcctcttgcctcagaatcacatagaccatgttacaagattatagttcttaactgctctacagataacaacttgaacattatgagatggtaagttttctatttgagatattcttgcatgtcctgcatactgatgaaactactgacattagctggtctgaaggaccccacaagaagctgaccaaggaatgcagtttacatattctgataattttatctcccttaccccaaccaatcaatgatctgaattctccagcccttcattatccatgaacccctttaaaaactccagctacaaactccttggggagatggatttgagggtcttctcccatctctttgcttggtgccctgtgaccattaaactctttctccgctgcaaacccttctgggtcagtataattggtttgttactgcatatcggacatatgaacttgttgatcctgtaagaaattatggcaagcctagtcaggagcagtttgtgggcatttgcctaaggctcagtgttctgtcattattgggatggacccagggataagcccaaatggccacttagctccagtgaactagactgtctctgctgccttgcctatcaatggggcacataagtcacttgtgcatagaaacagtttctggttgtgaaaaacattgttggtaagttttatttgtgcaactggcaccccctttgtcttctccctatttcctggcctccttggatgtcttgtgacctctcctgaggtcttgtgaactccttggatgttctgatgtctcatgtctcttctgatgtcttgtggcctccttggaggtcttgtggattctcctgggtttttgacgaccctctttagtaataggaagggccttatttgagggaatttctcttaaattaaaaggattaaaaagggcagtgcttgggagaaatactcttgatttctgaaatttggaaattgagtttggaagtccttttgtttgtctttgtcctgttatgtatgtttgtatgtgaaagagatccctgaaagaattggtagtgaagctcggcaggcctaactcggggttaccatccacttttccactttgcctcaagaccacctgctgaactcctggttggaggtcattccccccgaccttgagtaggtcaaaggtgccaaggctagctgaggcaaatgtgagccttgctaggtcacccatgggtactaagtagagtgattagtgtgtacattttgttgtgcatgcattatttaggccagaatgaaaaatgttcatttggtttctccaagcagcccaccgggctttatgcaaaattgggaagacaagagagatctttattaggtagtgcaataggtaacttacccactaagggcacgaactcctgtgaaaaaactatggaaaagtgcaaaggcatgccaggttttctaggattccagttggttataaaccatggctcagtcttgtgcacatttgaaattgatgggcaaattacagtaaagtaaaaattcagagctcaaatgagtttatctgaaaacataaaattaaaagttctctgtctgtctttattttcttttctgcctgctttgtatctttcataaaccactgagtttgtattgctatctcatgactagaatttcaaagcaaaacctatagcatctttgtattgtctgtatgtgcatttagataaatttatatgtatgcacatgtattgtgttatatatcatgttcatatggtactaaactggcttataattaaaagaacactcataaataaagttcaaatatttttcaagttcatgtgacttaaatcattaattaaaaagctggctttaaaattattgataaaataaaaatagaaatgtctccagaattgtcagcatatatttttgtctgggcttactgatgattttatatgttcctcttctagatattttaaggtatcagattttggcacaaaggttataagactataaacccatccaaaaacagaatggtcttcgttggtgtaattttttgacaaataagactaatttaatgttttttgttcaatgaaaacagctaaatcatctaagttattggcaaaagtactcataagtttaagtttcttacttaggtgaactaacacaggctataaaaatgtcaaacagaaataaatttaaatgatgactagctttgtctaatatctcagttatcataactaatctagataaactgctaaaaataaatgagtaaatatgaatgggctaaatacttaaaggtaaactttttgtttgtttaaaatcttaaaattattttgaatgcttgttagatatctgggtaattttcagttaagaaacagttacgatatagggaaacaagtttctaaacattgttaaatcatttcaactataaaacactaacatctaacaaacagttcaggatttcttgcttcctaggttttcactaaaacttaaggttacctgaaataagatttctagtaaatatatagttctgcatgtaaaacgtgtcaaaaaagatgtgtttctcattagaaaaaaaattaaaaaaatataaagttgggtttttattaagaaaaagaataattttgtctaattcagaagttatctgaagattgattcaaattatgaacttgaaaagattatgaaacaaggtaaaaaggccagtaagtagaggagaaatatgtaaaaacaattacaaatataaaaatatatttttcataaggagggttataaaaacaaagataatacttttatatgaaaaaatattttgtgtgatatatttttgttctaaaataaaatgactagttatttagaaaaaaaaagaaagttcagacatgtcatagatggcctgtataagttgtgacaagactcatgaaagggaatttatgaaagaaatttagtatttgattaggttgactataattgaaaatattattcataatagtccttctaaagattggttatcctctgataaaacaagatttccttaaggtatgaatttactctaaataaaattacaagaggtggctgggcacagtggctcacgcctgtaatcccagcactttgggaggctgaggcgggaggatcacgaggtcaggagatcaggaccatcttggctaacatggtgaaaccccgtctctactaaaaatacaaaaaacaaaaaaaaaattagccaggcgcgatggcgggtgcctgcagtcccagctactcgggaggctgaggcaggagaatggcgtcaacccgggaggcggagcttgcagtgagccgagattgcaccactgcagtccagcctggacgaaagagcaagactccgtctcaaaaaaaaaaaaaaaaaaaaaaaaaaattacaagaggtttaccttttaattgtgttacctgtttcattttgaaaactcagatttatatctcagaagttcgacgtttgctgtttctcattgttttcacccttttctccctttgagaaggccagagatgaaaactctcttcttcatttttattttattttactttatttattttattttattttattttattttattttattttatattttattttattgccagctcctgtaacattctgtctctgtttttcactttactgctatggcctgacaataaaatatttatcttaaagctctagaaaagcaatgtttttctttagaataatttgattctgtatacttgacttttcttgctatgtctggatttttccatgtaacagaaaacttctcaaggtgttactaggagtcatgcattactagttttctagttttttgtttcctctataatataatttataaccataatcctggacacattcttcctgtattggattgattcaagtgcccttttcatcagggttgactttaaggttctctaaatgggtttcccataaggagaagcaatcacacttcactctgcaggtggttttccttggtgtttttgataacaggcctaagaagcaagattttatattttatcaatataattcctatgttgttagttttttgattacttaggaacattcagctttaagaaggaaagtttttacttctgtataactttctgtagtgcttttaaagtcttgattatcactttggttaaattaataactattattttacaatgacctgtgattctgttttgatcaaatgttttggccttttaacatctttgatatacatcctcaaaatcaaattctaaattaagtctctgacttagacttattgctgatacttatcaaagctgtaaaaactgatccctgcaagattttagcatctttttacagcttccagtcaaaccatgaactccagcatcaccaactccagcctgataattacatgtactgaaagagatatccattgaaagactccctcgaccccccctttaaagggactttcatcaggtgctattaattaatccttgtactgttaagttaaagggttttgattcctgggtgcacatatctcatctgaaaaaggcaccaactcctactaattcttaaaatattgatactattatctgacaccatactcaggttaacaaaagccttgtcttcagacccagaagaaaggtagcatgaaaatgatctgcttttgtgagacataagactagaaattaaaactattcaatctctctaggctcagtgactactgcaggagagatgggcatgtgagattgtaagggcctgttttgagggatacaattagttcagatgctccaaatcaaggatggcacagagttacctaaacagccaacaagttgaggaattttgccactctgaattccttaactcaaaagggtttaaccaaatgcttatgtttcgtattgctaaatggctacaagtcagtatctaagaccagaattcatttctataaccttactttttggctcttatatgctgaaaaggttttttaagcattattgagtgtctgcccacttccattcccatctggcccagaatgtttaattgactacatgtcttttgactgaaagtcatttggccataggggtctcaccaagggacaagatggacccaaagcaggtgaccacaccaacctgacaatgatatggcacaaaataaaaagctttgcaatccatgctgcttctggcatatcttgaccaaaaatactgaacccagaactttttggggaaatagatttgagagtctcctcccatctcttcacttggcaccctatgatcacggaactctttcctgctgcaaatcctgctaactcagtgtaattgatcagtgggcaaacaaacctgttggtcctataatagtcaaagtcctgtgatgcaaataaaccttaatggagagacagggttagtttgtgtttggtggtttaagaggttgtcatcaaagagtgagtaattaagatgggcattgaatgctaagagagaggcatttatgtgcagttgttggggaggaacattctaaaaataaggcccagcaagtgcaaagtcccaactttggaaagataaaagctacttgttttatgggataaaagaaaaggaaaaaaatacacataatgagagagatctgcaggaaccaggtagagtcaagttgtgtaggcctgagtcaaggacttgggcttcattaaagatttttgagaaaagaaaaacacttcttacaatgaaatcagatgacttcaactgatattcttaatgatatactgtatataaaaatatagacattcttgattggtcaggtactaataaaatgttttccacacatacagttttgtgaatttcagttacaactgaaaacctgtggattcccctgacctcacgtgctcttccatctagagagtctgaattgtaaaggagaggtccaaaaccagcattgatgaagacctaaatgacctatcactcatgaaggcttaggtctattgtcaaaggctgacactctagcctgatggagtgcttccttgaaacaggttcttacaaacattgtctgatttaattttcacaacaatccatttgaaataggtttaaattgcttctattttacagttgaagaaacacactttaaaaggtttaaggaattttcctgaggttactcagctagtaagtggtagagaccaaaaaaagaacttgggtctgttcattgcccagcctgggctctcccgcaaagcctgccacccacaaggcttgagatggagagaatctggggtaggaaatacctttctgtttttttcaaaaccactccctgttggcagaactctccttaagctacgcaagagggttgtccggttaagccatttatctttctctatcagagagcaggctctcttttctcatagctgtgtagtcttagcagtcagaattgataacagctgctggacacctgagctgtattattttgccaggagataacagagtgaatgacttgtagcagactcagaacactgatgagttcaaggcccacagtagagattgtgaaatgtaattcccagataattcaaggggaagagaagctaaacaaatctcggtttcactcttcgaatttgtactctgagaacaaattgagaaatctgagaagaaaagtcgtcatatttgaagtgcttcagagaaatttttgtcttctttttcctttactctttggggcttgaataccaacaagactcatttttgaaattagaatttctcttccatagggagtgagatttaacttaagataaaatttgatgcttccttcagagagagcaaatgtcttagatacaggtcagggaagcttttgctggccactcatgtgcatggatctcattcttctgctttgcctttttagtaaatgggtggcgggaatgtaggggttttttgataattgaaacgaggtgtttcctttcttgcaaagtgctaaatgcattaagtacttttgcaaaggagatagtacgtgcctcaatttagacagaaattttactttaaagaagttaattcgtgatgaaatgagggtctatcatgtgccatgtgttgaaacttagggatgagtcagatgctggtcctgctctcaccaggttcaccttcaccttgggagacagacgtgtagccaagtaactccagtgtgcaatgagtgaggctccatacactttcttgaatttttaggagtcccctcctatctttcatcattactccatcttgttagaaaggaggcatagctgaatatcattttagaagagagacttgccagtggatgtatgacgatttatatggagttactaaggggttcttagtgggcttttgagacagatctgaaggtaaattctaatgcttctgcttcttgtccctggcaccttgcatatagttcatatttgactcctcagggagatgagaagggattaaagggaagaacacagactttgtgactagttccagcacagtagccgccagtactcttagttatgtggctgtctagaactgactttgcttattacatcaggcacttctgtgactttctcagggaccccatactaggaaattccagtggcaggtcctgtgatatgggtgatgttttctcctagaaggccacataatgattctgtaccccaacccctgctataacccattctgaagtggccccattctaagagcctcaccaggtagctcttacaggtgaagttcatttggacttgcatcaaagctggaactttcctacatgcctcacatcaggttcacccttttcacggctgttagtagaagtcaatttaagtcttaatccaaccccttatctctctgtcatgtcatgggcagtcaatagttacagtctaaattttgcagtttttagctcactggttaataaagacatcacattaggctgggtgcaatggctcatgcctgtaatcccagcactttgggaggccgaggtgggtggatcacctgaggtcaggagttcgagaccagactgaccgacatggagaaaccctgtctctactaaaaaaaaaaaaaaaaaaaatatatatatatatatataaattagctgggtgtggtggctcatgcccataatcctagctacttgggaggctgaggcaggagaatggcttgaacctgggaagtggaggttgcggtgagccgagatcgtgccattgcactcctgcctgggcaacaagagtgaaactctatctcaaaaaaaaaaaaaaaaaaaaaatgacatcacatcagatgtaaaagactcaagacacattcaatatgtgtaggatcacaaaacaaacacaacaacaataacaacaacagcaaaatacagagtctattaaagacaaaacagcagaaacaaagtgaaaaatacatacatatgcagtatggaaaagatcaatgaaaagcccagagagtaataaatattattttccaggcagttttggctccacaggacatgcatcaatgtccggagatgtttttggttgtcacaactgaaagggaatttgctcctggtatctaataggtaaaagccagagatgctgctaaacatctaatacacaggacacatctcccatccacctactcacccacccacaacaaataattaccctgacccaaatgtcaatcatgcttaggggaaaaaccctagtgtagaggaatttaataagaacatgagtgaataaaacaatgcaataataaaatgacaaaacaagagaacgaagaacgggtaatagggagataaggaggaacattaagaatccctacaataacattgctagaataaaatagacctggttgaaaaacagatgcctactttcatcattttattttatttgagacagagtctcactctgtctctcaggctggagtgctgtggtgctattctagctcactgcagcctcaacctcctggtctcaaatgattttttatttttaaggttggatgtgattggacatgatcgcacattgattttcccacctgcatcaccaccactaacttggaaacatgagtcttgtcatttttctcaaggactcacttctacaaatttctgagtgaggccttgggaacaaatccagtccctcaggacactaggtctgggacccccaaactttccctgactctctaacaagtcaagggaaaaaaataatacaatattaagggttaaactacttttcattcccaataggaaatgttatttttctcatcttgtggctattggggttttgagcaccagcaagggacacttaataagttgtagatgcatcatgtgaaggggcagtaataattatttcatctgaaataaaccagagtgggcatgtgtctgctcatagatggaaaagtatgcattttgcacttgggtaacagttggcaactctgactagaaaaccttttttgactatggcaagcatccttcttacttggaggaaaaatttatgcaaaagacctggcaaagttcctggaacatatagtgtgcctgatcaatgaacatattactttctcaccttaaacaagtttactgtatttcattatttaagaaaaagcgggccgggtgcaatggctcacgcctgtaatcccagcactttgggaggccaagttgggcggatcacttaaggtcaggagttcaagaccagtttggccaacatggtgaaaccccgcctctactaaaaatacaaaaattagttgggtgtggtggcacacacctgtaacttgggaggctgaggcatgagaatcacttgaacttgggaggtggaggttgcagtgagccaagatcacaccactcactgcactccagcctgggctacagagtgagacgccatattcaaaaaaaaaaaaaaaaaaaaaaaaagagagagagaaagaaaagactcatattcaaatcttgtcttacttaatatacttttcctaagtgtacactcaactcctaactctttaataagactagatctctttaaagaagataaacaaacagcaaagcaatatgtatgcagttaatcctcaggaaaggataagataggaagtaaatggaaatgatatcttgaagcaaatccttcttagactccttcgctgcctctcagaagaatgctaaagtgtgacattttttctgatcacacttaatttatattgcatcactattggtgtagccattctttaattgaatttatttagtctcttcttcttgcactttgataggcgaaaataatacagcggggaccaaactgcagttgtttattcaaggcacttaaggggcaaataagttgataattatagtattgtttgataatgataaattatgcttaatgaaaaatgcaaattaagtataatgataaattatgcttaaatacagatgagcacatagggagagttcccacaaattattgggccacagaaactaacattttccggagaaatatacatcttgtggaggcctgaagggtgaataggagttgtcaggaggcaaaagaggaaaaacccatggagaggaaggattaacatgttcaaaagtccagcagtaagtaagagcatagtacggctttccagtgtttctttatgcaaatgtaaacagatacacatatacccttcttacctactcaaaagatagtgaactatgcacactccttttagccttgctttattcaaataacaatatattttgcagaccttcccatgtaggtacttaactttccagctgcttatgattttaatgagtacagcggaattaaaccagactcaactgatggtcacttggatgatttcttgcaataatcttgcaaaaatgttgctatgaataaaattgaaatagtttcctagcttgtcatttgtcttttacatatgttttggggcctaggcataaaggtgtttatttatacatagtaaaaaaatactttattttatggcttgaaatgcctcatttgttagatataaaattcttataatatctgaatctatttctaaactttctttctcatttccttcgtttgactttctattcatttgccagcactacaaggtgaaattcttgagtgtttatagtatatttaatatcttttaaggctatatctccttattgcctttttacttttagtgttattatggtcatattgttcattttttttacataagatttagaatcagcatatctaatcctgaagtaaatcctgattattttcaatggcttaatgttaatttatattacagagagagaattgacatctttatgagactgagtcattcttttgaaaacatgttatatatttctacttgtcatgtctatttttgtgttccttgaggacttctaaaaaagtttctgcataaagttgttctttgcacatatcttgttatgtttattcctatgcttgtttttgtctcttattaaaagtgaagtcttctttttcattatgtctccttttagattttttttttaatatgagggccattgattcttctttattagttctatatcctgctatctcattgtttttagtagttgttaaaatttttacaaactctctaaggcctggtaagacagttacatcatctacaaactatgtgtgagggtgttttaacctccttcctaccacttttaaacgaatatattttactcttctgatacattgctagtgcctttagcagaaaagtttgataataattgtgaaagctgagagagtgtcttgttcttgactttaataattgactatgtcacaaagtatgtccctgcattaatctagatttgtgtatgtgtgtgtgtgtatacacaagcagtcacatgtaagtatgtatgtaatcattcatttccatcatgttgcatttgttgttgttgttgttggatgaagaatgtagctgaaagttgtcaagtacctttcaatttctgtagagatgctcatataatttctataattaagtaaaataacataattaattatattaatatatttgttaatagtgaatcattcttgaattcttagcatgaggttacataaaagagatgagtcttgcagttttgtttttctgcaatcattatttttggaatcaatatttcgtcattacaataattcagaaatggcccttttgtcctctaatctctggaacagtttaactagtatgggaattgtggtttgttcagtaggattctcctatgaaaccatgtatttttgatattaccttagcagtacaccattgtcagagttttctccatttttcgtggaaattaatctattttcgtttctattcctatgaagtcagattttggtaaataatattttgtcaaaatagtttacatttcatttagttttctatttatttgccttgagtttaccaaaacgaaactttctaacttaaaaaaaaagttgttatttttatatcagtgattgttttccccttatcataaccgtgtttgtttcttttgtgttttttctctttttttctcaggtaatttaatcttttatcaattttggagttcttcaaagaagtaatttgtttatttattgctgaattttagcttgaagtattctttcttttcttttccattaattggttatttttcaaccttttgttctaatttttagtttgatgcttaatttgttaacttttattattttttgtatattttatgaagatttaaaacaatatttcacttgagtatttgttttgctgcatcttgattctgaactatagtgttttcactattactgttttccagaaattttgcaattttgatttgtatttctctttttacctaaaagttgctgataacagactaagtttttcatgacgatcaaatattaggtttatatgtataatataaacatcaggattttaaacacatgagaaaacttactctctgcatagcagagaataaatcagaggggaccaggctgtagaaccctctttgtatgtgaaatatgcttatgttcaaagataaagtttaggttgcctgagattgagcagtagtttgggcaacaacaataaaacaagcagatggatttgagatatataaagggagtataataaacttttcatggtgattcattaaaagtgctacctgaagctgaggaaagagttaaggccaacaaagttcagacatgggcaactccatgggtggtagagctacttactgaggcaggaactgatggaccaagaacaggtttggaaagaaagacatgaagaggtgtgagagtttggattttagatcctgagaagcatacaagcaatggtgttatcaaagcagttggatatataaaagactgtatggtgagagacaaattgtgaagtcattagtactgaggtgataatttcatatatagaaacagctgatggaagaagtttaaagtaacaagaaaaaaagcattgaaaagggaatcctgagtgctccaggcatttatgggacaagcagaagaagggtaatctttgatagatgatgagaaggagccagtctgtcatcccactgaattgtggctgccttgaggaaaacatagaatctgaattatggaagactgctgaaaaagtattaattgcacataaatgaatgcatgggcaaagcaattttccaaaactgatacagattattaaaactattatactcatttaattctagaaaactgcatcatgaaataagtggtggttgagctggcacttctaggaatggacaaacctctgtgtagaacccatggctccatcactggagtccgtattcagcagtaaaacagcctctctcagtcatgcttgctgtgagttacacccagccagcaggatcatcttgacagctagctatttaactaagttatcagtaagcaggtaatagtccctcagttcagtcaaaacagtcaaattagttgtacctgtagacatagcctttctttgccaacatttatgacacggacaggaatgaattaggaaatagaacaatagctccctgtatgtgaaagatgtgtcgtctgtctaaagagaaaacacattgtgtttattgagtgggaattgtcatggaagctttgcatagctttaaaaaaaaaaacacaatatgctaacttcattccagtgattgaagcacacaattttggaaggttttatggaaagaaagaggaaaaataaatagagaagctgaagtccgaaataaatgtgtgagtcagccctcatccaaatacaattattaccttcacgctttgccctgttttgtttgacctaggaaaatatattcaatgggatttcaaagaaaaatcaaataatttttttttcaaacactgtggcaaaaacccatctggccaaaattttacataattgcattctcaatgcaacccaaatacatatttttaaaaaagcggccaggtgcagtggctttcacatgtaatcctaacactttgggaggccaaggcgggcagatcatgagctcaagagatcaagaccatcctggccaacatgttgaaaccccgtctctactaaatatacaaaaagtagctgggcatggtggtgtgcgcctgtagtcccagctacttgggaggctgaggcgggagaatcatttgaccctggagacgcaggttgcagtgaactgaaatcgcgccgctgcactccagcctggctacagagtgaccctctgtctcaaaaaaaaaaaaaaaagaagcaaaaaaaaaaaaaaaaagaaaacaatcgattatatacacacaatgctgtgttcttaggaatccactgtcctattctctgtcagtgaaaataaaaacacaaacacaaaagcactctacccatttaaagctgcctgattatttcccctctgacaaactgctgcccctttgagatagctgttaaatctcatggcctttatcttttgacattttatcatattttgcctaaggagatttatagaattgtgctatgattttgtgccatgctttaactgtaatgttgtgctgtggtttggctccaacacttgatttcctcctatgtctcttctatgcatgaactcaggctgttctgcacattaaaagggcccagttatttattggatgagtaactgttgctttcttcctctcctccctctctctcttccttcccgccctactttctgtatacttatctctaaacaaatggtttatggatctctgcccacccctctgcatgggtgacttccacgggcagggaccgtgcagtactttggtcttcctgccatgtttcccaattaaatctgtgactttttctttcccttggtgccatccagggctgcagtcagttaactaaaattcaggaccagcgtgtggtggactgcttcgtttatagacatggggaattcaatctcaaagtacagtttcagttttaattgctaatattaagtggtttttgaatttctaatgagtacctaattagagcaaatgttttccttactaacaagtaattatagcattccaaacacgtttactttaattaaacaaaactggttgactaattacgaatggcaaggcaggacacagcggatttctatcttcaaggaactccagcagacattcttgtgtgggtaactacacattaaagctcacttttgggtgctctcagggcggctcctgatagtaccagttacgcaaagcgaagttgttcaactggaggctcagtgcctcctccatgtaatagagacatctccgtggggttcttctcaactcttttcaaaatttccccattgaacgaaaacaaattatgcctgagtgcatgtggtggttgcctgaaacagctgtcagaatgtaaagagtttttaaagactcaagtttaatttaaaaattatataccatttgcattatatgcaataataacctgttttaattctagtttttaaagaaacattttcctcaacccctcaatcctcccaaagataacaaacattcaactggagcttactgacctcctagctatagttgtggtttgagagcaggaatttcggcgactgaatgcaaaatccattcttttaaagctatggtatatgcctgtggggtatactccaaagtatggattctgtttggccatcagtattgtggatggctatacttcagtttcctcttattgatgttacatattgaactactgctgaaatttggaattagactctgaaatgttactattggcctttatgcagtatctggcaactgtgaaaacagataattaggtatttgttcacacttgtctctttgaatgaagctgtcattgtagtctgagtagggagtcacttaaaggaaatgtactcctaaccctttgaagaggccaatcatggtacacaaaccacatgagtcaccaaagctgatatggacacatccatctgtatgtgcttgggtaaaaagttcatccgggagagatgtgactgaggaaagatgatcatgaaaagcagttgtgagagaatgcttctggggaaaatggatttctcaagtcctgaggccaggttcacaacttagtaagaaaaagagaatattcacacacaggaattgacttgcatgatggcattgagcggaactggttatggtgtaggtcaacaagtaggaggaacaaaatagtacggaagatgaaaatcaaagatgaaaatggaagagaggtagaacatagagcttaacagagcccaggcctaaaatttgaggttgtacaaaaccatgcctgagtgtttcattgtgttacttaacacatgcccgtccatgcattctatgagtatttcactgccctttttcaggtgctggtcatgtagggataatgacatattcataaacgggtgtaatatgaggtaagaaacgacctgccttataaaagagaagcaggcaaatgcaataggtgttcagagatcccagcctggccttgcttctcagcttctttgcctgctcaattctgttctgtgactctcctcagagtgggttcatgctgattgttttcactagtcctgcttcgccttttcccttaaaatccacatcaccaactcagagtgttagaatctttttttttttttttttgagatggagtctggctctgtcacccaggctggagtgctgtggtgcgaactctgctcactgcaagctccgcctcccagggtcacaccattctcctgcctcagcctcccgagtagctgggactacaggtgcatgccaccatgcgtggctaattttttgtatttttggtagagacggggtttcaccatgttagccaggatggtctagatcttctgacctcgtgatcctcccacgttggcctcccaaagtgctgggattacaggcgtgagccccttgtcaggcagtgttggaatcttaccccagtgaaatacaatagtgacccatgggccctgaacactcacatgtgcttagcactgttctaagggctttttagatattaatgaatccaatttgaccaagggtgaacagctactacaccaaagagctagtatctgacccaaagaggctcatttcctagccgaagtctaaaaacaaacaaacaaacaaacaaaaactccatagtatctatttgatgcctcctttgttatcatgaagtatctctgatttatccatatggaggggtctctgtctcctctgaactcacaaagcattctttatgcctctcatcaaatacctttctcactatcattctacatttggggagggggctcttggaagtatgactcatggagttttcattgttttaaatacattttgaacttttgaagatgttttagcagaaaattttagagtaatatcaataaatatttgtaatggaatgattgatcctatatctaacatacaaagaaaatgcctaaatagtctcagattctcattttaatgttttttaattttatatttttatatttttgttggtccttggaatgataggacttagggatttttttccttggctgatcttgctttgaaggcaaagttataaaaatatactttgaatgatttgtgattaatttattttagtataacttttttcttttcttttctttttttttttaataaacagaggctaagcaaatctttggagattttctctagttccctcttagttctcttctgtggtcctctccaatgtcctagcgtttgctatttacttggctagagcctccagtctggtatctgatccaggcctgcctttcctaaaaggccctactatgcttagctctttttaaaaagccagctttaaagcttttattagtattctaacagataaatttatacttaagtattaataattgcccacttctcattattattattattgttgcaattgttatctcagacagttaggaataatgtttggaatggcaataatggtattctttagttagagatagtactcctgcttgatacttaaagtgcctcataaaattcaaaggaaatcagacatccaatttcttactttagtcgatgtaactattgttcacttaaaacactcatgagttcttttcatgagtcctaactcagaggaaacttcctagagctcattaaaactttaggctctgtttaggtgacctataggctgtgttggcatataatgattttgtcttttgagctccaaagatataccattaatctaatgttatcaagatttgaaaaatggatttataaaaagtaaacacagctgagcgcagtggctcacacctataatcccagcactttgggaggccaaggtgggtggatcatgaggtcaggagtttgagaccagcctgtccaacatggtgaaaccccgtctctactaaaaatagaaaaattagccgggggtgatggtggccgcctgtaatctcagctacttgggaagctgaggcagagaactgcttgaacccaggaggcagaggtttcagtgagctgagatcacgcctctgcactccagcctgggtgacagagcgagactctgtctgaaaaaaaaaaaaaaaagtaaccacaagggtattattctcctgaagaatcctttgctttctgatatgataacatttgcttatcagaattcagtttctggtatgatggaataaattacaaagtcactggacaaattagagggtaaattcttaaaaatgtgaattgcaaggtgtagatttcaagtagcacagaacccagatgaatttcatccactacctgcattataatcaggaacagaaaaatggagtttactttaacactatgttacttgagtgcaaaatcccagctccacaaaactctgatgtcctgaaatttgttcacatgccttagttgagctaattactagaatgagtttgggcaagttactttcccctcagcaggcttcacttttcctcactgtaaaatgaaagtgtgggtctgtgaatctctgagatacttccgattttgtgcattagtgattccaagtgagatttccttcagctagcatgccattaaatgctacatttttatttgctttctgatttccctcttttcatttatgaaaagagctcacaaaacctttttcctgtctatttgctcttggaaaattatgggctcttggaagttttcaatttaaattatatttacttttcattctcactccgtcagaggcatgtgcatatgaaaatgtttgtcttccatccataccctactgactcattaggaacaatcagagtgagctgttctttttcccctgctaataataacaaaggaaccaaacatatatagatgagattgtatcttcaaaggaaatttacgtcggatttgatatttattttcacaattatattctgacgtagaaagcgtcaacaccaatttcccaaatgagaaactctattatagaattgaaatgggagctactctgcaaaacccctaggtgccatgggtacaatcaaccatggttatgtgccttccccacagccatttacccttaccctgtcaaaagaaaaactgttgttttcctatgtactcaaaatacttctgacaccaaacatgtgggttttctaaccaagcaattttccatttctctgtggacaccaaccgagtgttctacaatttaactaaattctgaaactaactccctggagtcagtgtgggcctacagtttaagtgctcattcccacaaggctgcccaccacttcagataccaattgcaaggcccagattgttacctgtaattctcataaactggctataaatatgaggctcctctaaccccttattgtttgatagttggctataaacactcacaaaacccaagaaatggcttatttaggtttactggcttactataaaggatacagacaaacaatcaaacgaaagagatgcacagatcaagatgtagggtgcagcacagagcttttatccctctcccagtgtgcactctctcagcactgacgtgttcatcaacctaggagccctctgaactccattgtttgggttttcttttgaggtgtcatgacataggcaagattggttaaatcactggccttgtgattgagctcaatctccagccgctcttcccttcctgagggaggttagaggtggggctgaaaatttcaatcctctgattacatggttggttcctctggcaaccacgcctcattttccaagagccatctcaatctcaggtatgtttgaaaaggacttattatgaaaaacaatagacgcttccctcacactgatcactcaggaaattccaagagttttaggaacttgtgtcaggtaccagggacaaagaccaaatatgtatttcttattatgtcataccttgcccgcatacaccctcacacacaaacacacaattcacacatgtacagaatgaaaaggcaaagagtaacatctttatatctgtgtaagtcaattagtttaggatgattgcaaaagttaaaacattccatagaacaggaacatagtgaaagctcaacaaatataataattgagcctgctttctcacctataaattatgatagacactaccttgaaatggttgtaagaactatacatgtaagattatttaatacttgatgcccagtggcgtctcaggggatgatagcctctctttctctttctctttctctttctctcccttcccttcccttcccttcccttcccttcccttcccttcccttcccttcccctcccctcccctcccctcccctcccctcccctcccctcccctcccctcccctcccctcccctcccctccccttcctttcctttcctttccttctttcagcaattccaaacttgcagactgttaggaactttggataatttctccatctcgaaagtaagcttgtgatattccataaatcacttagcttagacttaattgtgctgtaaacaaacaaacaaacatatctgaatggcttccaacagcaaatgtttacctcttgccctctgttcatgtcttctgtaagtttagctgaggtttggtatactctgtatccaagactcctgtgaagaaaagtccccatttgggacatactcgtctcataaaacaggggaaaaacagataatggcaccatgcagctgtttttgacatatttgcttagaggtgggtagcatcatttctgcttcactgtattggccaaagcaaatcagatggccccgcctgctgccaaaaggctggaagaagtaagattgtcacacaagaggagatagccaacatttggaaatagtaccacaaaccatcatatttctaaacatattttaattgctctcatacacatgaatgattgcaaactcgggttcctcatttgctcatttgtttatgcatcactcaccagacagtcattgaagaatcgctgtgttctagatactgtgttttctgatgtaggtgatacagagagaaagaaaacgcaatctacgtgtagctagaaattttttgtcattatttcttttttcagctcaaatgaattctgatagaaaatttttggtagagagcaaaaggaaaaaatactgtattggggaatgtgtgtgtgaatgtgtgtgtatgtgcatgaatgtgtgtgtgaatgtgcgtgtgaatgtgtgcgaatgtgtgtgtgcatgaatgtgtgtgcgtgtgtgtatgcgtgaatgtgtgtgcgcatgtgtgtgaatgtgtgcgtgtgtgatgaatgtgtgtgactgtgtgtgactgtgtgtgaatatgtgtgtgaatgtgtgtgactgtgtgtgaatgtgtgaatgtgtgtgaactgtgtgtgaatatgtgtgtgtgaatgtgtgtgaatgcgtgtgtgagtgtgtgagtgtgtatgtgtttgcgtgaatgtgtgtgtaaatgtgtgtgtgcatgtgtgtgtgaccgtgtgtgaatgtgtgtgtgaatatgtgtgtgaatgtgtgaatgtgtgtgtatgagtgtgtgtgagtgtgtgtgaatgtgtgtgtgtgagtgtgtgtgcttggaagatgagcatgatgtcaaacaaacatacacttccaaaagtagtgggcattcctgcttagccttttgaaagcgatatggggaagagagaaaagaacatgagccatgcctcaggtactccatgtccagggaatgcaaacttcataaaggcagaggtcacatctgcttctgctcacttctgtgtctaaactcaataactgctctttggaaaagaggaaaccaagtgacccaacacatggatacacagagtcaggggacagcagttcccacagaagaccaccgcagcaaagctgctcccaagtagagatagtgatgcctgctcacggtcacaggctgtcagaggttatgtgcccagcaagaacaaaaggaccattggaaactgggtagcagttggggccgttctgagaaggcaacagttcctctcttctgtaaggacaactagagggccagagggaacttcgtgttgagatggggctgtacggcacccagggtttagtgatggagggctaggaggctttgatccaggagcagaagaggcaggacatgctcatggagctcatgaggaacaaatcacatttgagagagcagtcaatggtaattgcaagtctgaggccgagcatggtggcttacgcctgtaatcccagcattctgggaggctgaggcgggtggatcacccggggtcaggagttggagacaagcctggccaacgtggtgaaaccctgtctctactaaaaatacaaaaattagccaggcgtgatggcgtgtgcctgtaatcccagctactccagaggctgagacaggagaattgcttgaactcgggaggtgaaggttgcagtgagccgagatcactccaatgcactccagtctgggcaacaagagtgaaactccatctcaaaaaaaaaaaaaaaaaaaaaaaagaaaaaagaaaaagaaagtctgagcaggttttctgggacttagcagtgttcctatgcaggctatacatttacatttaatgttaattcttttgtggatgtgttttccccattaatttatcttcttggtatgactttccccagagtgcatgtaagaaataatgtgctgggcaaagcaatggcttggtagaagaaacccagcacccctgcatggactgcatacttcaaacataacttcaaacctcctactaggtttgaagatccttaaagaaagggatatctgagtatcctgcatatattaggtgactggtgaatgcttggggaatggatatgtgagtaagtgacggtgtcattgtcatgagaaagagaaatattccttgcattttcttattctatcaatcaagtctataagatgtctatttactcttatactttagcacagtgctggtgagatgaataaacaggcattaaagagccttctagagcatattaaaacaaattacttgctttgcaagctcaatttaattttatttccttaaaaatccaacaaaagtgcattgaatcacctctaagcattaagtaatgtgcaaggttctagggtttcactgatgatgaatatgtgattcctactttcaaagaccactttcaactgaagaaacaggttatctaattttaaaaaggtagcataatttgtactctaacaattgtatttgtatagagccaagacagcattgttgttctctctgcaaagttctcagggacgtgttgttgacccagttgttagggtggttaaagctgtgaatgaaccctattttaaggcgttagcaagaattcagtctctttcatcatgagaagcaatgatcaaggaacagatacatttataaagttgaagaaaataccgaaaaatgtattgaatctatgttttcccaggaagattgtcttttctttaatttatccataaaaaatatctgattttacaattttactctgtgcctttaagagatagaaaggaatgaattctattacattgcattgtttggtgccaagccataaatttacatagttgcaacataaacagtttcaaattataactctacaatatccaaacgaaacactatcaattcttttgttattgacttgttttatagttgtaatgcagactccatatatttgttattcagttttttattatattatttctcaggcaattacatttttactgcaaatttgggggatttacttgatataatcattgagtacaagcatagtgctaagtatttaaatgagaatgttatcaaatgaacttaatttttcttgtcctgttgcaaccagattatttttactatgtaagatttattaaaacatattttcaattatgctgggaaatttaaatgaggcaagcattccacacataatattgcctcccaataaggttgacatttacaagatggtgagtaacattttgtgtgcttatttcttaactacttttgattttgtcaatacaagataaattagccaaaatcaggcaactatgtttaggcatttgtattaatcaggtgctccatcttgtctgcaatattgataggaatgtttagcaactgtgccaagtagactgagtggtaaaaatgaatacagattttgctataaattgcaaataagtacaaaattaatctgattgacttaatcaggaatacagaaaaacattagcatttcaagtacttctattttgatttgcaggattcattggccatgtaaaacagcaattctataaatcctcagaagaaatagcagaactgcttttacaaattaataatgtttatgttgtgtaaagtcattttagacagtgccagtttggtgttattgtttaggaaaaaactgagccttgtaatgaaaaataattgttcctctgtcataggaggggtttaagacatattccttgattgaatgtttgatataggctcaagcactggtgggaagttaaagcgttcttggtatgacctcttctgcttgtccctgttgaccaagttctttaacttggacacaactcaccaccccacaaaccctctcctggtattttgtgttggggttcctacagtaaatatcagttactggagaaaaggacttttcaaagaagcatgcctagtactaacactcaacattcacattccatattttcttttaaccaactgtctaaataagtatatattgcacgaatattcagttttaatctatcgtaatgttctcaattattctttgaattagctagttgctattattgagctgatttagaattaatcagtttttctgaacacatttgtaagaagaaacaatttaatcttttccccatttttacacctcaaaattatcttaagaattcatttacttttgagacagaaccatttctagtttcagtaccacttttgaaagagtacacatataggtagatcaactttgaaaaaataacacaataggtagtgtatataggatatattgtatagaaataggaggaaactttcctgtaataggaaaggaaacttccgtcttctgtttgttaagaaatatttgagagatctcaccatcctgccttcttgctttggccaaattgaataaacctttctctatctctcagcacctatgtgtcatgtttggcattagctacacatcccatacaggagcctgaatttgggcttctacaacatgagggtggcctctagaaacaaccttaagagccccttgcagtaacccaaacaggagataatggtaaaagaacttttccctttctaggatgctttgtagaataaaacatttagatgtgttggtgacaggctgggaggctgggagaaagggtaagcaagaccacttcaaaggatttattgcctctgaaaaccaggaatgttaaagctgttatctactgtgagagggactaggttgtaatgagggtaggatcaggagttgggttttggacttgcaacatttggaatgactactgccatcccagtggcattcagtgagctccacccatgaacaccaagcaaaaggaggcaaacaggagacagtgtcagaaacagaggatgcaccggcagaggtgaaagcaaacagcctgaaactgaaacataactggaagagtcaagctgccgcttctcatgattaattttagttctgtgtgggctaaggctaattagtaatgtaagaattacatgagcaggactgaaaagtatttccccagccgtggcatctggctccttaaagggttgtattggcagctctatggtgctctccaaatctggcatatggctgaaattgggttttggcaggtgtgacttgtgcccttgtaccttttcattaatgcatcctgtgtttattggaataaaaatggtattgaacataatccatttctaagggaaagcaacctcaaaatgatatatgtttgcgaacataaataacatttaataattaaatgtcatttctaactattaaaagtgcttgcatgtggattattaaccagttgacaatcattcatgggaaggtcactatgcatatctcgttattgtaaaggagtgataaaaaaaaaggttgatcattattgggtattggatctgcacactgattagataggaggggtcccaagggagaggcgaagttggccagcagtggggtgagcacggggagtgttggggcagtggctgtgtaccagtcatatagtcagattatgacacttgagcagccctttgtttctagtgttttccagctaatacttacactggtttaagcaaggtatcttacaggattctctcaacaatctggtggtttgtgtttctttggcaattgaaatagatgcccagaaaagttgtgattttcctaagaacatccagctggctgtgagcagtactgaactcacatccagatgaactggactagaagagcaggctacatgtttttgaaatttctaaggattgttaatattcaaatcttctttctcaacctggtcatataatctctgatatcacctccttaaactcatctagtaatatttcccatcttcagagcctaaatgtcaaatgtcatcagttttatgcttttatcttacaataatataaaataaaatgactttactcaaaccacattgcaaaagcatttttccagcatattaacctttttataattgttgatatggaagagttttaattccgtcataggttttatgcattttaaatattgagtcttggactgtgctgatatttttggtaaataaacagaaagatgtgcaactgtgctgacattacagtctggagaagtgagaaattaactctgtaggaagtcaacatgatgtcagatcaatgtgaccactaaatagatgagagttgccagggcaacttttcacatgctctaagcaatgtgatggtttgttttcctattgatgcatatgctaccctattttggctaacatccaattcaattacgtaagtatttattgcaccctttctacatatccagcatattttataattttctgacatcattcatatatctattcaaaaacgaaggcttacacataatgaactggcttagactttatctactttatctaccaggaaattgattctttttgtaaaaatgacgagttccatcggccaggatctataccaaattccgaagccaaggatatgttagaaaatattttgacacaccagcctttacttgatctgtagtataaagcaagagtttctaacttgcctactatctttttttctgcctctgagataacatatacaggttgctgttatggcccctttaaccatgagtataccaagggcaaagaggtagaagtgagtacaggcactttagctaaacatttagttgagttgagtttaacttttggtttagttgaagtgcctgcacttaatcaactaaaagttgggctgctttttgttattactgtgcatggccaatccaactcagtgtatttaactcatagactcataaatcagtgcattaactcatagacaactgtgtatcttgtttgattgattgattgattgattgatttgtttattttgagatggagtctcactctgtcgcccaggcttgtgcgttcttggctcactgcaacctccacctcccgagttcaagtgattctccttccttagcctcccaaatagctggtactacaagtgtgcaccaccatgcctggctagtttttttctttttgtatttttaataaagatggggtttcaccatgttggtcaggctggtctcaaactccagacctcaaatgatccacccgcctcagcctcccaaagtgctgggattacaggcatcagccaccgcacccggcagtatcttgttttttattttttttctttaactttctaagtatgaaggaagctacgattattctttccaaatctgtcaggtcattccattcctctgcaccaaaccctgcaatgatccccctctccgtgcaggaaaaaaaacacccacagtcccttcaatacatccaatatgctgtgtgtgctgccctatggtctcacctcctccccactgctccctttcttcctgtgctcatttactgcccctcaggcctttcaccatttaaacagctgtgcccactagcctacctgaccactttgtaaggatggctcccaccacctgagtcactctttcatctaatatccatgcagctccacagctcttctttcagttttacacaaatactgtattttcattgtggttgccctgactgctgggttcaatacttcagatcccacacctagcatgtccagctccccacatcctgtttcatcatattagatcacttaacatcttaaaatacactacatattttgctcacttattgtgtttactttatttttcctcccactagaatataagaccaaaaataaagatgattgtctgttttgcttttttgtctccctgatgtatctcaagtatctagaagaatggcacagagtaggtgctcatttttgttgttaaatcaaagagtgaaggaatgaaagttaatcctgaatcttgtattctgtcctatcattattttaaatatcttaaggatgctcttacaaataagtactaaaaaatagcaggagaaatctatgccatccaagaaaatctctgacaagctgtcacatgtttggacacctttagtcagttgaagaagaaggggagttgtggtcttctgggtaaagaagttgccctgggaggtgactggagaccatcttacacaaaataacttgccttgatgcgagagaagccggagcaaaggatagtccttttcagatcaggtcaaaagaccacctacaacgaaatctccagccatagagaggggcattatgtatggcagatgccagacgcccactatttaatccaaagaagaccagaactggaccaagtgcactagaatatctgcagatgggacatggagacctgtacttcctagcaacccaggagaccctggcttgacctaaactttacctggataattctattttcttttttgttttgagatgaagttttgctcatgttgcccaggatggagtgcaatggagcgatcttggctcactgcaacctccacctcccgggttcaagcaattctcctgtctcagcctcctgagtagccgggattataggcatgctccaccatgcccagctactttttgtatttttaatagagacggggtttcaccatgttggccaggctggtctcgaattcctgaccttatgatccgcccacctccgtctcccaaagtgctgagattacgggtgtgagccactgctcccagcctgccctgagaattcttaccaatggtgaggcaccaagcatcggattggagggagaagggttggtataaaaacagaagaaaaaggaagaagatgggagggacataaatcacaaatgggctgagaagctctattattattgttattatatattatttattattattagcttcattttgcaaataaaataaacctcaccaccaagctctagcagcaaaacatttgcggagcaccactgtgtgcttggccccaggcacacctgccatctcatctctatcgacacagattgttcattttgcagatgagaaaagttgataataggagagataaagcaattttcataagattgttctctcattaagcaaatatttatcaaacaccttctatgttgtctgtgggtggggcatcctgagaggaataagggagatgaggtttctgctcttacagagttcacattcagctgggagaggcagaccacaaaaagcgactaatcaatgatgaagaagctttgaggtcacggagaagaaagtgcgtggagagctgggatgcagtgtctggagcctggctctggcctttcctctcctctgctaggctgcagttctgggcaagagcagacttcactgaaacccacgctggctgtgttagccaatgtgttgacagcaccctgtgtaaagaagtcacccaacactgcatcagtgtgtaaagtggaaacctaacaatctcacaatgttcacgaaacgctaaggacatcacaaggaatgatgtagtaaagtttttccactgatgtcatctttggaagtagattttgctcaattcttattggaacatgtgcacagctgaacttcaagatccttgggttctcagctcaaatctatataaatgacttaaccaattgcttaactttctggaattcagatgctttaactgtaaaatggtttggagctctgaatggagtatttccaaattatatctaactgtgaaaattcaatgacatagaagatttaggatggagaggaaaaaaaataacctacataacgtacaaatgaataaaaattataacaataataatataaatttattaaggtgagatttaaaagaaaaaagattgctatttttttattgctagttaaagctattcttggaagatttccaggtactttttaagtgaaacgttgtgtgcatgagatgtccttatatctttttcaagtatatagatgggctctattcaaaaagggcctctcttctcgtcttatgcccacctgccatctgagcaactatatctattttttgctgggctacgtggaatgattgttctttttatgttcttgcctaagaacacacacaaccacagcactcctgacacttagaaggagatgaattatatttaaccgaaaggacacttgcttgactaggactgctaaatgtgttagctgcagggaaggccagctgccttcttggccatttggacatgcccaatcttctcttactgatgcacagatgtctgaggccttgtgggtgaatcccagtgtgcttgcagccaggagaaggtattgtgagcggtgctgagcatgtgaggtgacatatggttctccttctccatttgacaactttatcagcttctttccatagttcaagtttgcagctctgcagaaccaaaggctgctattcaaaatagcctcatcacctcttccttactccctcaacctccagcccttgtccaattgcctggattgggaaagttctgcagtggtttgagcaatcacttaataagacggctgtcggtggtaaaactggaattggttgttgctattgttgcggctttggtgagtatcacaagtaagcactggaaaattagaagcacccagaggttttagataacatatatgtaatggacaatcatgtcagggacccattgattcctatatagaaacacgctgtgccgtaagtctctttacttgtatgtattataaatatttagaaaggaaaagtgtgtgtgggggtgtgtgtgttttatactcaaaatgaactttttgatcactacaaaattcatttggtatggtaaaatttagaaataatctggaagttaaaatttgaagaaatatcaataatggccctttaatatataaacatattattactattataaagattatatagcaatattaaaataataatcatctaatattcaatgacaatggaaaatataaaatatctatactcatgatatctctaacagtgtgtgtatatgaacaatgtgtggaaagaaacacattgaattgttgatatgtgatagtggtaggactcttgttcttattttaaagcttaatttcattagaatagcatctgcaaggcatatatcaaaatatatgtttataaggttttaataaataagaatatgaaataaggtgcattgatctcttattatgtgtcaagtctttgggccgttcatgctcacagccatgttgtgaggcagacagtatgcccattttacagatgaacagaccaaggccgattaaccaaggttaaattaattgtccaactgtagctacaaagttacgattagaaataagttctggtgttctgttgcatactaggtttagtgtggttaacagtaaggtattgtatattacagaatagctagaagagaggcttttgaatgttcttaccacaaagaaatgataaagacatgaggtgatgaatgagctaactaccctgatatagtttggacatttgtcctctccaaatcttatgctgaaatgtcattcccaatgttgtaagtgagacttggtggaaggtagtgtattatgagggtggatccctcatgaatgacttggcaccttccgcttggtgatgaatgagttcttaatcacatgaaatagttcacacaagatctggttgtttaaaagtctaggacctcctgtctctctctctctctcttgctccctttcacaccatgtgatactccagcttccccttccccttctgccactattgaaagctttccgaggctcccaccagaagccaagcagatgttgttcacagcctatagaaccatgagtcaaataaacttcttttctttaaattacccagcttcaggtatttctttataccaatgcaaaaatggcctagtacataccctgatttgatcagcatacaacacatatacaaattaatgtaccaaatcatactccacaaatatataaaattacaatgtgtcaacttaaaaagaattacatatttgatttacaaattttttattccttttaattctatctcagtattttttacaatctttgattactttctcatttttctaattccatcttttatttgttttaaataaatattttaaccaaaactgttaaaagaagagcaacgtgcaccaaattaagttcagtgctctttcaacaacatgaaatttctattatgcaaagtactgaaatgaggtacacaaaaaactcttgttatcttagagcgagtctattgtcaatgtgtctggagagacagagaacaaaaatcctaggtctcaaaatagatgattctttttttggaatagtttactcctaaacaactgatatacatgtttttctattgtatttcaaataggtgaagttattttcactaatcctgtcggtgctcacagctaagtcctacaatgacagatcatctaccagcaatctagagaaaatcagttttgtgtatagagaaataagttcccctggcccaccatggccagcatatgacaaggaaatgacagaggggactgactatctgggccaggggaacaaagggaggtttgcagagattctgagggtacacgcaagagagtagggagcatttctgcagcgagaggtacttggccatggctacagcagacaaaggatggtcaggaatactttagccacaacgttagcacagacattagcagaatgctaaatcgtgggatccaccataaccagaagaatgctagatcagtcccacctcagcaaggactggcaaggacccccaaaacaaagaaaaaattcaaggactctgtcactccataccacaagttcacaggagcccttcatcctccaaacagtgtgatgccacactgcggacatacagatgagggcagaattgatgagactgaaaaagtgcctaaagggattatttacaatattggtttggacacagttttgaaccaaattagactaagtaaatttccatttttatcatcaaataaaggatcatgaaggaacaccacgtcagttttagacaaaatgcgttctatatcggcatacacagatccccctccatactgtgtatatgtgtttactcatatatagatgtgtgtacatgcatagtcacataccttattgacattacaactatcatcacaatggttttcaccatactatagcacagacaaatatttttattttattttattttagtttagtttagtttatttatttattttttttatttttcagacaagttctcactctgttgcccaggctggagtgcagtagcaccatctcagcttactgcagcctcaacattccgggttcaagtgatcctcccacctcatccgcccaagtggctgggactatacgtgcataccactacgcccagataatttttttattttttggtagagacagcgtttcaccatgttgcccaagctggtcttgaactcctgggctcaagcgatccacctgcctctgcctcccaaagtgctgggattacaagtgtgggccactcaccaggccaaatcttttgattacaaatctatttgctcaattcctagttctgtattcaacactgatattgttgttgttttagatcacacacaattcacattgagccagtaatgtctttgaagcattactgaaataaaaatttcagcatattctcaataattttgcagctcctccaaatttaatcactatatagaatctttatttacagttttaaaattgcactagccatctcttccttcacctttttttaaactgtacaaaactgagaaggctgaaattatatttttctcataattttacaaacatacctactttttctacctaaaattatccagaaagtgctttcttctctatgtgttgtgtggaaaggcttctatatgcctatttttgaagaaaatagttcacttttactccattatatgaaattttttcattatttaaatcctgtgattagttttttcactgaatagtcacttccatagcagtttggttaaaaattctacagtaaaagtagtaagtgttggccacttaccacttgtaaagtgtatgggcatagctgtatgtgtgtgtttatacatttatatacagatgtgtgtatattaaatatgtaatgtaatataatacaaatggtctctgactaatgaaggttaaacttatgattttttcacgttacaatggtgtgagattggtgcacatttagtagaagccatactttgagtacccatacaacatttctatttttcagtgcagtattcaactaattacatagctcttcaatattttatttgtgtattttatgcacatatttattttaatacaaacgtacagctttggtcaaatgtttaatattcactgtaattttatgggtgacattagcaagatctatttgtctaaaaactctttcttacaaaaaaacccactttaaacttctcaaatgcccctccatcccatttttttaagtttctaataaacataaaacatatttttaaaagaagaagaaaggctccagaagatcagaacaatacaactggttttaccaaattcaggcatttagaaattgagaaaagaggcaatttttaaacttatgacatgacaacaggcataaaacagcctgctatggacaaagcagcaagtgtagtcagcctgctaaaattcagcctctgtgagcacagcacttaattttaccccttattttttagtagaaataggatctcagaaatcaccggacttctgtattggtctcgttggaagctgcagaccggaactgtttctatttggccatcttggccccccgccgccaattctactgtaaagacacatgcacacgtatgtttatagcaaagacttggaaccaattcaaatgtccatcaatgacagactggataaagaaaatggggcacatatacaccacggaatactatacagccgtaaaaaagaatgagttcatgtcttttgcagggacatggatgaagctggaggccatcactctcagcaaacaaaggaacagaaaaccaaacactgcatgttctcactcataagtgggatttgaacaatgagaacacatggacacagggaggggaacaacacacaccgggtcctgttggggcgtggaggaaaaggggagggagaggattaggagaaatatctaatgcatgtggggcttaaaacctagatgacaggttgataggtgcagcaaaccaccatggcatatgtatatctatgtaacaaacctgcacattctgcacatgtatcccagaacttagagtaaagtaaaaaaaaaaaaaataagaatcgcactatgtttcctaggctggtcttgaactcctagccttaagtgatcctcctgcctcagcctcccaaagtgctgagattacaggcttgacccaccatgaccagcccaatatggcttttaagaagaagctgagccagccccacctgtttcgtttggttctggtgctggcctgtgttttgacaacatgcttgtaagagttttaggttctgtcagcatcagcagacacagcccatccttctctccaaatgactgttcccttaggcacttgagtcacttttcagtaaacatctgcatcatacttcaaatcctgttactaacatttgtgtctccaaaatttattctccaaaccccaaaccccgcacactttaatgcaggcctgaagtagatggaaaaggggaaataaatgatgtcaccatagcttatcacatgacctaaattaacttttcatgattgaccagcattaatattcacagatttaacaatgctttttaagaaaaaacaacagtccagaagtgattctttctgtgtggtagatataggtctgtttatttttaaatgtgtttttctttgtactttttcgttctgaaaactcttgcattttcatttaatatcactcattataaagtttatctctgaagtaggatgtattttctgatcatattttcatttcttagaaatatattgtattttaatacctcaattttatcagtatttttatatatacttgtttgcttgggggaagatatgagtgagagaagctttgcacttctttctctatgggtaaaaaaataaaaagttaattttagcattagaatttattttagcttactatattcaggggaatgcaaatagcaaaatttctattcttctcaacactctttccaagatgaaatgtgctcagattgttcaaacctaacttaatagctattagaatctgtcttgtcgaaagtctcagattctttattttactctttgtagcagcaggactctttggtccaactgcccgaaaaactattgtcaagaaaatgcccagtgacctccaaactcctgacctttcaattacctcagtggatggaccgagagaaaggtgacttttaataaaacacaaataatatcactaaaccatcaaaaattgaatcccaagacggtttctcactaaattttattttccctgcctccctcaaaggaactgtgtattgaagttctccatctgctgatgatctcttaggcttatctcggtgtagtacatccatttagcaatgcagataatcagcatttgcagaatggcactcagttttgcagctgaaaagattagagtatacaatccaccattcattctcaagggaaggagtcatcgcattgaagcagtctaattatggccatcagtccaaatggcatggtggccaaggatcaaccccaccagcataggaagttccaggctccaagaaagcccagaggttttggaattagtgagctaagtgagtttgcctcattcccacacatcttgctcctcacttcctttactgtgccctgtggttggtgacatgactgcatatctgccacttctcaccactttgtatattcaccctgccttgtcttgatttctcatcttgataattctcccatcttttgctcaagacacttttaaacaactctcagagtaacatccttctttggccctagtgagcatttgaaatatgttctatattctaaagatccagaacatgtgggcattttcacgatccagcctgtcaccatgtgttgtttagccacacgtgttcaaagcagatttcgagttgagttatttctagctgggcacaaacagggttccattttcataggcctcactcttccctactgcattacatggtttcttcttcacttctactacactactccttctttaaattacagaagcttaaacataaacaaaagtagaacaaagtggcataatgaaacaccacaaatccattactttgcttcaaaatttcttagtacaaagctattattttttatacctacatgcctgtgctgtaaaatagatggactactttgagccaaatcaaagacatcttataacttcattggtaaatagcttgtatttataagtaggtaagagacgttcactttaaaaagcacaaatcaaatatcaattaaacattcaaatctcaagaattctcacaatccccaccccacccaccctcctctatcttctccatccccattacactatcactcttcatttgactggttcaaatcagaagtcaaatgaagttgacacgttgtgtttggttgatatgtcaacaaagtcacttataatttatcatttcttatcttgtaatttctttttgaaaatgttgagtttatcacatttgcccttttcccagcaaaaggcatcccagtgtctcctcactatggagtggaaggagcaagaggtttataatagcatcttgttatattgaagtcacaagctaccagcatcttcttatattgaagtcacaggcaggatttaaattcatcttatatgtaagtatggtatcccagtgtgtcagtgaagagacagatgttactgagatcaccttgcccagggacgcatctcctaatatctgcaaggatgtcctgtataccaaaagtatagcttcattccttctaatcccaaagactctcaaataaagcaaatctgcgggaggacaaagatgatggtaagcacagaggagaatgggtatcaatcacttacatcattaggaaggagtgaaatcttacaatgatctttccctctgctttcttcctttcaggtgatctaacttcctgtgccagcatcatcattttacaataagatttgactttggttaaagtttgaaattctcctctgaggaaacacatttcaggatgttatctttcatgcataccttatcatgaagaaaggatccaactattcataatctagatttccactgatttctttaaccacagtttgataacaaccaccagtgaggtagtcaggtccaggtcttatggaactttattctgttcattgggaatgtgggttttattgatgagggagtgataaactattggagaattctcaattgtggcgtcatgtcttctgagttatacttttacaggaatgattctggttgctctgaaggaacagatagatgtggggagacaagaataaaagcaaggaggcttgtaactggctgttttcatactagaggtgagtgagagagtttgagagtttgatctgggctttagaggccatagtcttactttatcacttttacaaggaaagaaagaaaggcccattgtagtaaagtggcccctttaagaggccatagtaaaaggatctcagtcctcaaatatataaaatagtatatattttttaaaaattgtaaaaacctttgccattcattttctgacttaaaatgcctgatgaggttgtcttagttctcagatttcaaatcttctgatctatgcatggcacataagttcctcactgaacaattgatgattaattataaatgccaataatggttattgtttgagaggagatgactgtggatatggagaagtaaacagaacactctcctttctctttgacttcatttaaccaattttttctttcaaatcattttctagtaagaaaccacctacaaatgcccagaggattgctgccttatttaaagtattataaaacttattgcatatgcataacgtgactgtgacgtggaaacttctcagccttgcccagtccttttgaaatgttaagctcactgtaaaaatgataaaatattgttattttctcttaagaaataataaaattaaaacccaagaaggaaaagactctgctaataaataacagtgtcaaatttaaagaagatatttgcataaatattaggtttaaccaaatgaaattgccaatattcaaaagtttttaaccttcaaagcatcggtttcatatggttccgtctattacaaactcttgctccttccaatccactgtggcaaccttcagaaagatgggggatattaaatgtccttttgttctcacagagtatcctttatgttgtgaacatggacttagttatcactgccactctgtgggcttttatgatctattataacctttactatagtgcaaatatctgtatatataaacacatatatatatagcctattagaccctgaatatcttaaaggcagagaaagtctcttattttccttttataactagcaactggcatagtgacagacaagaatggatgctccatatgtctttgtttagaatgatataaatgcaggggttgatgaatcatattcttttaataatcttataagaagcagtaatgagaagccattttgacaacaggcttttaaatcagacaccctgggtttagatgtgaatccgatatttacttcctatggaagttgggacaagttgctcaaacttgaagtgcctcagcttcctcatatatgtaacagacaatacttacctcacagagatgtagtgataattcaataagttattgcttagaatagtgagtggcatgtaataattgccatatacatgttatatgtgtttgattgttatttttaataattgtttgttgaattgtgattcctgtgtgtgtgtgtgtgtgtgtgtgtgtgtgtgtgtgtcttgtggaggtagtgatggcagtgggaggctgttctcactagtgttgctttcagaattcgttagcactaatttgccagccaattacctgggaagtatggcatctggttgaataaaggagtcataatttttataacttttgtttttgtgaccctttgcaattttttgaacatccacagtgagtctcagcaaataaagcatctggaaatgaatattagttgcaaactaattgaagcaataacactaaaaaagattaaaaaaggataattgtcatgtttgagatcccacacaatagtgccaatatcctgtgctgaatcttttctgaggcctgaaaacaaggtaaggggtcattgcaggcatcatgtgattctttttcacaggaacttcaggactgaatcctgcagtagaagcaagaacaggctattgggagactctggtcctcaactgcacaaagaagggcccatatcctcaactctgccacagacctctttgattccagttggaagcctggagatttcactgctgctgaggagggttccagggactgggaaacctgagctgtgagctgagcttgggtgatctgtttccatctgtggtctggtgctgatggtttccaaggcaggaatcaagtcagtccttgaagagctacaacagagcaaaagtgcaggtatgagagcatagatggacaaaaaaaagcaagtaatcataatcagagaagagctggagcagctaggaaatttagaagaagagaacaggttacaatagatgccgtgaacacagcgatggttctaagactatgcccatcttgtttacttctgtggcttcagtgcctgacaaatacatagtcagcactcatcaaatattaaataaatacatgcatgaattgtcaaaaggaggtgacactatccaaccacttaaagtataaatttttccagatagatacaatgctacagatacattatcaaataggatggaggaactagaagattaagagaagcattagattgctctactctggaagtaatctccagcaagataaggaatcaattctctttgcccatttaattaccatatttcctgaagatttagaaatattttatctggctccctggtcctaatatttgaggaatctatgatttgataaatggaacaaatgccttacagagatatgatatagccagggtgtcttgggcagaaatacgtaattggtaaagtcaagatggtggaaggtaagctctgtttctgaagacaaatcacatccctgtacttcagacttgatgggtgtctatgagcaagaatgttttctctatctgagccccagggtaaaagacaagacatggagcactctaatgtagccaatcgactcagaatatctcattttaaatatattttttcatattagatgtgcgagtgggaaagtaattatgaggtcacacatcctttccttaggtaaaccaacatttttttacatttaggaagaaactgaataaaactgtcttttgtccaagttaatataccttgtgaaccccagctttttgttaagaaaacaaagtgctgtgacttattttaaacaacagaagggaaacatgacttctgattcataacttcccttaggcttgagggtctctgaaaggagagctggaaatgctgagagatgtgaagatgctttgggagggcacagtttcccctttgccttatgggagattataaagtttcacagactatcaccactttactttagaattttcctcaatacttccctctagaagtttgcagggaagatctcttcttggttattaatatgtttcagaaatgacaggctaaagttctacctacccagatggaagcaaactgatttttggcttctctgtttgagtggcagccagtgtaaccctgggtttctggttgaaattccaatgcagagattcccaagccatcagctggaagacacaactttcagcaacaactctgtttgtgcccatcaggaagttggatgaaataattttaaaatatggatatctgtacatccagatattttcagacaagttcagaaagattattttataagggatgcaattagaaaaacaattattacaaaaattgtactatatttaataaacctcctcctatgtctcctacaatgtgtgtgttattatcagattgatgggaacatcactgaataatcagatcaagtgaatttgattggtgagaaaaaaatatgctcgcttatgaaattaacaattggtcatgacacagagtaacaaagattttatttattatttattctattataatgtttaaatatataattttatgcagattatgcattttgcataaattctgttatgcaaaatataaattctgttaagttctatagagggcagaagtttgatttaagacaaatatgagaaaatgttctttcatgactgaataatatgattctggtaaaataagtgtctctgagagaagcctcagacttgtgtttttatgggaagagcgaaattcttcttgcttgagggcaaccttttgcagagaggaaaaataatagcaagaaggaaaggtgaggactactttttgatagtggaaatcaatctgtgattcatcacaaaatacaagtcatctggagctacaaatttatgggtggtttaaatagcaagaagcagaaagcatatacttggggataactggaaagaagatcagaggtgacccaagtttcaggaattgaactaaagagatggttggaataaaactttttcagtggaaaggcagaagaagggaagtgatttttattgtctactttacaacacgcttagccaacattatctcactttaatccacaccacagccgtagcctttcacagtaatatcatccacatatcacacagggatagatggggttatgttagataaattgtccatgaccacccagtgagtaagcaacagagccagaactcaaacctaggttgtcatccaatgtcaggcatttttcaagtttggaaaaggggtctatacttctaaatatatagagcaatattctgaagagaaggttaaataatatgttgaatggagagaactttatcctgtctgaacaacctctttcgatctatttagattacatgtgaaaataaaaatgttctgttttttctctatatggtaaagaataaaagtacatatgtttatcaaagtgtacaatattctaaatcaggagttcttgaataaattaattactacatgctagaattcttagaaatttagattacacactttgtttttataaacagatatttaaataacatcggtctttgcgtatctatgcacacgcgatgtagaggatattttcaccaaatgtaagtgggatggaggcggcagtttgttgacttttcctccaatctttattctattttaaagcctttagggaattgttccttcagaaacaacgtcagatactgtctcaaagaagcttttctggaaagccctgatattaaaaacaaaatgagagccacaaacaacaaaaagtccaggatgtccagagaaaatggtccatcttcaggcattcctgaaagcagaccatcaccaactttgtcatcattattattatttgctcaggcatttctaaggagataacatcatatctcccaggaactgcctcaaaggcccaatccacacaaggaagccctatgcaaaattttcaatgaaaatgcattgcctagagtaaagatggagcattaagagaagatggaggcagaagtaaggatctatgagtaaatcaatggccatgaaaactggaggcactaaaagaagctggaacaaaacaggttgaggtcaagatcagaggtagggaatgcactggtgaaatatacaagctacgtagggttagatggttcaaaggaaggccttttcatgcagggttgtacctaattgtagacttaaaattgaggcttatggaatcacagtagtggttgaccctaaatgattatgttattattcttatcccctcatatgaattttttaaatgactttctgctaaagacgcatttctatttcaaaatttagtatcattatctaactctgactctcttcctaattcttgtccttctaaatcatttttgagagctaattaggttgagtgccattttcaactgctactttggaagataaggtacatgcctgcatattgtgcgcttactgctgtgcacatctgtgctcaatatcaatctgcagggattctgaaaattaacatccctttaaaggcaaacaggattacagggaaagctatgtattattacttggtgtttggttttacggatacagcctggatttcaattgaaaatagtaagaaaattagaaaatattttctcttttctaaaaatgctcccctcctccacacacacatagaaaaatataattagaaaaaatcatatcttaaaaagcaaataagtactttaaaaatatattcatagctttgaaagatgcactatgtcaatataaaattaaatccatttttattgtcaagaaaatgggctaatagaattttctaccaattttatgataattggcatatggataaaacagaaaaaaacaaagtcttgattagaattactgtatctggaggttttaagttaggggaaaaaaagtcaacttttttttttcctctctctctaacagtttatcacaagcacagtttccccccactactttcaattttatattctaggttttagacctctgaaatctgagaagatctgtgcctaggggaaagagactgccttgaagaaacatgtgtttgtgactgagtcttatcagagtataaataacacaactgtttccaagaagaaaagatcagataacatatagtcaattgtagcctgcagggttgaaagaattgacaggttttattacttgctcaaatgaatctttaatactttttgttttgttttgttttgtttttgagacggagtctctctatgtcgcccaggctggagagcagtggtgcaatcttggctcactgcaagctccacctcccaggtcacgccattctcctgcctcagcctcccgagtagctgggactacaggcgcccaccaccacgcctggctaattttttgtatatttagaagagatggggtttcacagtgttacccaggatggtctcgatctcctgacctcgtgatccacctgccttggcctcccaaagtgctgggattacaggagtgatccaccgcacccggccaatactttgaagatagtaagaaaaggagcaagatcggtagttaaaaacaccagagaatgttgctagaatgagctccacaagtgtatgttgaattctctggtgttatagttgggacgacagagtagacagagggagtgattaaagaacagaaacttaacacaccggagcacccttgtttgtcccgtgctttacagtcttcatttaacttatcacacacatagcaagtacagtatagacagaaaccaagacaatatgctataagattgagtaaaaaggaaagtgatttaaaagaataaggaagccaaaaaggaagcagtttgtggtcgcctgagagatttgtgaccataaagcaggggctggttaatattttctgcaaatatccagatcgtaaatatcttagattgagcaactattcaattctgctttgctggtaggaaagttgcctagataatatatcaacaaatgggttttgttccaataacactttatttaggaaaactgaaatttgaattttatattattttcatatattacaaaatgtttttcaagcactaaaacatatgaaatccattctgtactcctggattacacaaaggcaggcactgggctggatttgtccagtgggctaccatttgctgatccctgcattagggcctgtgcttataccttgacttcaggtatctgcaaggataaagaggaggaaccctataacaccctcaagttctctctgaccactgtgatttttaaaacacactttctttgaatggctatctttttcctttaagagataacctccacatttagaaacatagacactagaaggtctggcaaatgaaagagaattgtggattatttttccattgaatgatttaaaaataaataaaacaactttgattgacatctggtagattaaaaaggcaagatttatttcctacaaaataaagaaactgacacatatgtcagacacacgtggcatttctgatgtggaaagaaggaaagacatcaataagaccaattaatttactttctttagctttgtggcaagtcacctaactcgtcaatctgtgtgcaggcaaatatgtattacattgttctgtgctaggatggtattaaacattgccactttttaatttactctttattatactgacaggtaaacaaagcaacacgaaggctaaataaaagtcatttccccaaggtaagtttacaatgttggttcatttacagtttagtggtcttgaaagtgaagagtttattttgtattgttcaactagcttgctttgctgtggatacacttgctcaatattagttataaatgtaatggacatgtctatataagaatgagtataggtcctataatgtttatttaaccaggctgaataatgagaaacatccttgtcatctatcacacccttcaaataaaaagatgagcaaccctgagggtgcgttgctttttctttttttttttttctttgagatggagtctcggtctgtcacccaggctggagtgcaatggcatgatctcggctcactgcaacctccaactcccgggttcaagcgatcctcctgcctcagccttccgagtagctgggattacaggtgcacgccaccatgcccagctaatttttgtatttttagtagagacaggtttcaccatgttggtcagagtggtctcgaactcctgacctcgtgatccacccacctcagcctcccaaataaagctcagcggtacattgctttaacaacattaaattgcaaggtctatgtctcataagagagcaggttaggactagtctccacaggtccagtggcaatatccttagtatcataaacaatacactcagaccattaagacatactggaaacaacattttggttgccactatttccactgatgtgtaccagagacatatgaagacacttttacacaagttgcataataaaaccaaagcaatgaataaactttgaacatttgtgactaaatgatacctacattgtatttaattatattatgcatatatactgcatttgactctcactccaaatatgttagaaacttttcatattaaaatataaagctctattttcattcaatagatgatccttagttaattcaatgagtcccattcattgatgaattgtttgccttcattttgtgttaatttttttgtcatttttttcttctcatgagttttgttacctgatatgataacctttcccagtgaaatattttaattttatctagctatacattcttctagatcttttttggttataggcatttttagttttcaatctgtgatttttctgtaattaatttttgtaagaactaaattaaatattatcttttttgaattatcttaatgtctcacatcacttattgagtagcctttctatcctcgctagtttaatattactgcaatttttacaaattgaatagccatgtgcatttgtatctatttctacctctagattctactgaactgtccagatatgaaataactacaataaacaggctattacaatattaataaactatcttaattgtcttgttactattttttctgttacagcaaaataagggtagggaccttcagatggacagattagcctggattaagcaggtaagcccaataaatcacatgagtcattgactatggtgaactttttttctggctgggagcaagagacgcaaagatggaaaggttagagagatgctatgtgagaagactcaatattctgtctctggctttccagatggagaagccgaggatcaaggatcgggccaggagccaaggaatactgccacctctagaagttgggaacggccctcagcttacagccactaagaaaagggggattttggccctctagctgcaaggaatctaattccacttgaattaacaaggaacatccaggcaggaatgtagccctgacaacaccctaatttaggccagtcaggcccggacagacttctgacccacggaattctaaaataatttgtgtttcttaaaccatcaaatttgttgtaatttgttatggtagcaacaggaatcaaatatacctctctacttttacaagatattgttgtctgcagcctgtttgaagtcggtgactaaacacagctggttactatggcaggcccattctgaagagttgcaggacaccctcggg

SEQ ID NO: 39 - DNA, 10584 bp, Homo sapiens
cccgcagctgcgccccacccgggccaccaagcacggtggagggggaacaggacactgccttcttgcttctcttctctctggcatctccctcttccgcccccttccttttacccttccctgttttcatctactcgctgtgagcttctctctccttacaaaccctttttcctgggctagacactctgggtcaagttcagagtatcgtgtcctcaaggcctcttctctgcaagaaaccccgatgattagagggctggagggaaaaactcatggggaagaaagcatggggtgttttcaccaaatgccaaattcatctcagttttattgcgcgccaactgcatgtgaggcaccaggtgcagggagacaggagacagtatccgagctccaccatcgcggtatagagggtgagacgaacagtaaccaagaaattaatagaataggcactaaagggcttggcgaatggaggctccaccacactttcctggagcgagtgagttggacaagatgaggtttctctgggatggcgatgtctgagctggggccagaagtaagagttggggattcaggggtcccatcacctgtgtgtgctggaaggaaatctttgctattcttagcacggtggtgtggggccagggcgaggcaggaggtggaatggaaataattaaataggaagcaaaaattatcagtccacaggatcctggtgtgatctgcgagggagaggtggatgaacccaggagtgaggtccttctgcttggaggttcctgctctgcactcatccaaacacccagcaggaaaccccagtttactgcagggagaacctgaagttgtatactcgttttggctacctttgcccttcagctgggaggaaaagcagagtttagaaacaagtatactctccgtctctgggactgtttcattatttgtaaaatagggtggctgaagttggaaattcacgggtcctttcccgttaggcgatttgaggagaaaggagcatttggacactatggctccctcggttttcccacgcctaacctggaagaaagccatcggcccagctgcttggggggctgccccctaactagcaaccttggtgacaccagatcgggtgttttcagcttctggcttttggtgagctggacggtgggagcacgtctgtccgtggggtggcttagccaggtcgcaggagtgccgtgagcgggtcaggcccgtaatttccatctttagtcaggagctagatttctggctagctctatgtggccagtttgtcctaggccagaagacgtctgagaatagatgttacgactgaagcttgcaagaaggcccggggaaaagagcagcttcttggtcctaagcccttttcaaagtaagatgttttctctttcactgtatgtcggaagctttcctcctgccataggagtttctgcgcgatttttgtccgctgagacacttgagagagccgagcagcggacagcctcttggcctcgggaagccacagaattccaaggacgctcacagtttgacaagagcctgctggagccaggtggctccttttccttggaacaagaccgtgagacaacagccctgtcccagcccaggaagctggggtctcctgcaccgctgtcaggccgctgctgaggagctctgcgtgccgcacacttaagggctctccggacttcgaccccacacgcagctcgagcaaagggatcttttgttgatacctcggatagcatcccttccgcgggttgctggaacagcagagtctccttttggggagcagctctgggaccgtgcccgttgggcacttgcggctcctgggaaccgatcgaggggaggggcccttcagggactcccgggacaaatcttgggcgcataacgcgaaccctgagcacaaaaaatgagccaggccctcactgggtgagctcgctacagcccgcagacccgccgccacaacctcaggttcagcgccaggggacgccaggggcttggccagtgtcttcggcctcggcgagccaggttccacgcaacctgggacaaaacagtctcggaggctgagcgaagcgccccgagcctcacgcttccgcattcaggttgtgcttggcgagggtagaaagtacttcccaccacctaggccacagccggacgcggcggcccaggccgcaattgctgcctagagcgcagacagggagctcgggtcgcgtgtctgttttggagagtggcgggctgcggccgccgcggaggatcctgggggattccaagcgcggcactgggccggggtgcagagctggggccgcggtggggaggggggcgcgctctcctcttcccctacttccccggaggttaattccgacaagttttgcaggcgctcagtggcaccggcgggggccggaacgcgcgcgctccagctgcctgcagaccccctctcaagaaaaacagatcgtgtaaccaccctggcaccaaccagtcggtttcaagtttccgcgagtaatttttttttgttgtttttaaacaactactgcactatccaaatattggctggcgctcaggacgctggcaggcaaatcattgccccgggcttagtgtaattatctcaggcgtatttggtttaccccttaggcaattgttggcgacgctatgctaggaagaggggttccatgcaagcttttattgcgtttaattggctctatggaggggagtaaaaaaagatgtggaactttaggagcggttatttattcattctttctcctccatgcccccagcccctggagggtctcacgcgctccttgggctggatctaggccaggccttcccacggcttctgcggacagctgtgcccagggcgaggaggaacacaagttaccgatagggctaggacgacgtacagcgctagaaaaaaggcaaaggtttaggcgcacatctcaatttccatgggttctccctttacgcactgacttagctgacgtgcggaaggttgcctgggttagttacgtttggggtcctcccaggagccttcctggtcacgctagcctggcacttgcctgaccttcggctgacttctcggcgcatacttttcccagacgaaactcctaaagtggatttgaagagggtaggagaaagccagccccaggactcggaaacgtggcttccagctcgagtccaggcctggatgaccctggaggcatcatttcaccgctttgggcttctttttctttccaggaaatactcagtagtcagaactgcgccttcgaaggctccaaggagttgaggtttgaagctgtgatctcgacggtggagtggcgctgggggtctgggcgctcggagcggggagctcaggagctgcgcagctggggacgctgcagggcagcagcgccacccgtcaaccccttataacgttttaggaatccgtcgcctccagcgtcaccaacccgacctgacatctctgcgaagtgcatccctgccccgtttccgacccgtccagtccccgcgccttgcccggcaggcgcccaggacacaggtttggctccgccctacttggatttgagtgcataagctcgatttgacttttcggaatgcccgagggtggagggcagaagggaaaagcctgaggtcaggggcatttatttcttggagaaaaaaagcactggccttgaatttaggagacgatactcgagctccagcttcgccacctactggctgtgcgactgcctcttctctgagcctcagtttccttttctctaaagtggcgatgaccctgttgccttaaaagtgcgattctgagacgtgggattttgagagtgactgctggaatactttgatccagtaaacctctatcaagagcctactgtgtgccaagcgtcagaaaacgccttgtaaagtgtgaagcattgtaaatacataagatgctattatcgtttttgctgttagaagtcatcatcttttccttcctccaaatctaattgtacctaagaagagctcgacaaaatgaagcccgacggcggtacatgagcgggtggatgtatctggcgttggagtggtcagccgcggggtgcacacggctttctctcgcagtgccaccggccaagaaagacagcccagctttcgtcccccaaagtttctagcacctccgctcgcgggcgagactggctgggttgtctgagccgtaggtgtgcgagtttgagggaaggaggatacaagggggtccagccagcagcggagagccaggggatagcgccgggccgcgcaggctcagggttgccgtgccagcgtcgctccacctcgacattgaccccaggctctcgtctgaccgaaactcactccgcaaagaccctacgtgctgcccagagtcagaaacctgacttttaaatctccactcttcgaggcgagattcgtctcgaacaccgcggctgtgtacactgcctgtggcccggggcgcgcaatcagcgtggagatgggaagcgtttgtgtcaccctagcagagcaatttcccctttacagtccacccgcgcctcacacctcttggccaacatccagaagctttcctacgggccgtgtctgtttaggtagcggccactgacaaccataaccaccaaataaataaccaacgattaaaaattaaataactttcttgcgctccctccgacgactaataacaaagactccgcacatcagcaaccaggtgtcgcggttaaactcctgacagtaactgtcttccttttcagccagccagttctggaatacattacattaattaagtctttggtgatttagcctccttggagagaagtccaacaatgtaattaagagcatactggctatattagatatgaatattcaaaacagtgtcaattaattagccaacagatctagctcactatgcttcgaaagcccctgaagtcctctaagatacatttaaagggtcatcggcggggaaaggagaggggggtaaagaatattaaagaggtgggtccagatgatctcttcgttccacataaacattttctaatgatggcgatttataacgtccctgacatcacataccgcacctttgggcacgtgggtgcccgcccatgtctgtgtgtgtctggtggtggtggtggagttgggggggcggggcggatgttgttgatccatcagagcaaagatcttttataattaaagtgaggaggcatccaactggaagggccttcttagaggcaccaagaggctatccattgtacatcctctcagacatgttagaaagataaatattaaatctgctatcacaaagggagctgttaaatagatactaagctgatatgcataaaaaattaattaggtagttttctcagcatcaaactcctggacaaataactacttgtaaagtacaccttctgggcatattgaacatatgctggaattatccttaattgactaattacataaattactcattaattttacagcacatcaattataaaagatatatcaattaattttgcataaattaagactggaatctccctccccccaaaaaacacaagagagaggctgctgtaacaaaatatgcagagaggggagaaaaacaatgtttgtgtatttgtagattgcaataataatttgttctgctctgggcagagattttcttaaggaaaaacatccttggcaattaaaatagtcctaaagaccacttacgatgtgatcatgcgtgcaccaaggcgaaacagaccatttaaatcaattaggactgctctgatggaaaatgagggcctggcaatgacaaagtactcagacattagtaatcacaaatgatttaacatccacattaaatgcctgactgggtagtaaggcttattttcctaagtcagcagggtgcccgtaacgaagttatctctgggtatcccaaagtagacttcggcaacgatttcacacacaattggtggaaattaatttgacacctctcttcaacctaactcctccagcctgctcgtttcgggctctcctaagcggctgttggcctcctcacctcctccctcgtttccttaaaaaggtcattaaatgcttcgtcacgagcccagccgtggggccctgctccttctgttttgggtttctcctcccctggtgggactggcggctttcagaatacagactgtgtctcggcctaggctagcgggtcgagaaggtgatttccaaggggtgagcaaagtctgagacccccggctccttgactcttcctggcccgccctccgcagtctgccaggctgaggctgaaaacacgagtttccagaaaggctttaggcaggctgcgggcgccgggagggaagccgggagaccgctgcgcccgctgcgcccgctgcactttggcaacgaggcctgcgtgattttagtcagcagggggcgctgtctcccctggtcgccgccttagagaggaagccgccttcggtgcgggttttctccgcacagcgatggaggtggagagatgtgagtttcctggggtagcggcacttctagaaatgccaggctatggttcactggtttcccttctgtgtgaaaaccccaatctaccttgatttgtgccaaccatctgtaatgcttttcatagataactttagacaacatcaaatcaaacggtacttgaaatacatcccaaatttcctcttggaagttgtgaacttcgaagttgcacctacaaatatagaggtgcttttccaaaagaaacaaaaacttccttgaaaggaatccgtagtcattatttaatgccagccccacgtgtgtattgataattattgacaatagaaatatagaattttctatgttgttaagaagcctttcaacgatataagtgggagattcaagttatatagaatcatatggttcaaaaattttgtttttatattcttttaagtattttgtattcatagtgatcattcataactctgaagtaaaataaatcagaatgacagacaactggatgttggagaaacagaaaggttttactttcaagagatgcctagtttggtggatagtaagtttatgatcagcagattcccaatcccacactcataaattggttgtgttaaaaatactttgttttaaaaccactatgtatttcactcaaagtgaaatttcccctaggaataatactgtaactggtagataggatcccagctagttggtactgttccgctttaagtcctgttaaaccagtaatgtatctaaaaatttgaatttctcctttgagactgatcacaaccctaaaaggtccttttcttatccccttctgttgctagtctccaaagatactggctcccacccccatattggaccatgccttctggaattcatgcccttgtgcagtttcttctcatattaaatctgacccagtcccatgggaacaagtagcatgtggcagaagtggtgcagtatgatttcaagccaaatcagaaggacccttgcagcttttgccttgcccttttaaaacacacactctggggtggtggtggggattggggggtgggggggcagtgccagccaacaggtaagaagtcctacggctcacactgtgaggaaatccagtttagccaaggagagagagagagagagcttggcgggggagagagagagagagcgcgcactcttggagagagagagatgcctgatcagccaccagctctgccaaccatcccaagtgagatgtcatatgtggtgagtaaaggaactgtcctggatgtccagtccagttaacttctagataatttcagcctcagttctacctgactgcaactgcatgagagaccttagtcaataacctccctgctgagctcagtcaatctacagaaacgcatgggctaacaaaccattgctgttcaggcattatgtttaggtgtgatttattacacagcagtagataaccagaacatacattgtcctgtctcccattctttttcctatactattttttcttgaatcttatttctgctacagtttgaatctggctactcatgtgagctagcctgggaatctgaacactagttagaatatcgaggctgggattgtgtgccaaagagattggcaaggagagtagatgaaggagactgcaacataattagacatttctatttacgcttaggaaacagttacgagaaactaaatactgctcttcctcggagcttctcaggggctggcactggaggatacaactgtcagtaagttcctaagtcacgtgctcaaagagaagtgcctctattagaatttctatctcaatcatgtgcattgttttaattaaaggtttttttctaatattctcaaacaacagatatataattgtatttatagtatggaagacaattaaattagaatctttttcaagataaaaatagtgtctttgaaattgctcacatttctagagaataatggtgctatgatcagtagtttctgttccattagcttctcctttccaactaggcaaatcaataaactttatagtgtttgtttttcaccttttattgccaccatttattcaagtgcagacttgccattgtaacttgtacttctggataggcagtcatatatttgctttgttatattgataagatttttttttttttttttttgagatggagtctcgctttgtcatccaggctggagtgcagtggtgtgatcttggctcactgcaacctccacctccctggttcaagcgattctcctgcctcagcctcctgagtagctgggattatagacacacaccaccaaacccagctaatttttgtgtttttagtagagacagagtttcaccgtgttgaccaggctggtcttgaactcctgacctagtgatctgcctgccttgacctcccaaagtgctgggattataggcgtgagccactgtgcctggctaagttttttttttttttttttttttttttttagcgcaacttgtgctggtccttttgtgaagcaagaatattcaagagtttatagatataaaaatatcctcagctcttactaaagaaaaatcatcttcctattgttcattgtagtctcatctttcagatggaaaaacagataaaatcccagacattcccaaagaatgggcttcataaggttcaagtagatagctggtatggattttaattgtcttctaaatcatcctttatgcagggaaagcctaacatgtttgagtgattactttttgtttggcatccaatagtgccaaaatggactttggcatcagactgatttggttaattttaggtgctttttttttttttttttttttgagacagaagcttgttcttgttgctcaggctaggtgcaatggcatgatctcgactcactgcaacctccacctcctgggttcaagagagtctcctgcctcagcctcccgagtagctgagattacaggcacccaccaccacccctggctaatttttgtatttttactagagtcggggtttcaccatcttggccaggcttcagtcttgaactcctgaccttgtgatccacccacctcagcctcccaaagtgctgggattacaggcgtgagccaccgagcctggccctaggctcttattatttagtgagtgaccttgggtatgggacctaacttttatagcctcaaattactcatatgtaaaatggggatgatagaacctgaaatagagtgattttgatgattacatgagatactggacctaaaatgcacacggcgaatgcatcataaatgttagcaacctgtcacttactcaggagatttctggggtaaattgctgttgtattttcacttgttgatcactactttggaaaggttaaaagtgtacttttaaaaatctcagttggcagggtcttaagatgacttgaatctatcaggttgtacctgaagaatctggagtatccttcctcatctaattctccagtttttctcccctcgaattcctctgtcagaagcacaactgtaagaacaccaccacttctctgctcagaaattttcaatagcagtttggagatgaccttaggcaagtgcacacctcttagcttcacattcaaaaagccttctacaattgggcctctgggtctatccttctagatttatcacattccctctgctcctaccaaaggaggtcagttgcatgctcttccgaatacatagccgcattttcccccctgacttcactcccattgttcactctttctgaaatgtgtatcctcttctatttttacctccccaaactctactcattcatcaaataagacctcattcaacaattgcctcctccacaaagccttctgttacctttccttgtagaatcatctttttcctctaagtgtctagaacatgttgtttacacttcaattatgcaacaatcacaacctgcctttcttattaatatgcaaactttatgaaagcagggatcattttttatccaatttttgtttgccacagtagttagtacagttaaatcagtgcttcccaaaccatctttgaaaaagaaccagctttgaaaaaaaaaagcaatctgttgcagattgagatgtttgtaaaacacaataaaaatgaaagattagaaaactaaaataaaaatacggggcaaaatacaagcccaaatgtctctctctctt

SEQ ID NO: 40 - DNA, 4241 bp, Homo sapiens
atgtgccaccacacctggctgattttttgtatttttagtagagatgggatttcaccatattaaccaagatggtctcgattacctgacctcgtgatccgcccgcctgggcctcccaaagtgctgggactacaggcgtgagctaccaagcctggccaagtgcaacaagcttctaaagcaagaatgtggactccacgttctgatttgcccacttactagttgtgtggcttcggttggacttgtgttagtcatttttgcttctgctcctctgagttctcttatttttaaaatgtggataatggtacctagctcaaagggtttctgtgagagttaactgagttaatcactgtaaagtacttagaacagcatgctctaaagggagaagaagaggtgtggagaaatggagtagggttgaagaaactcctaaagctcccttgagttcagaagggagatgaggccagctgggtatagtgtgtgtgtgtgtgtgtgtgtgtgtgtgtgtgtgtgtgtttaggggaggttggtgttggtctcagtgttatctaagtgtgttgtacaggcaaggtaactggagaaaagggcaaggaaaggcaagtcttaaaatttcttagaaagacctttcacaagccaggtgcagtggttcatgcctgtaatcccagctctcagagaggcagaggcaggaggatagcttgagcccaggagttcgagacctgcctgggcaatatagagagaccccgttctccacaaaaaggaaaaaaaaaatgacaaaaaaaaaagaaagacctttcaagaataatttctaccaatgagtggatcaagaaaatgtggtatgtatgcaccagggaatactactcagccataaaaagaatgaaataatgtcttttgcgacaacctggagggagctggaggccattattctaagcgacgcacctcggaaaaggaaaaccaaataccatatgctctcacttacaagggggagctaagttattagtacgcaaaggcatacagagtgatttaacagactatggagactcacaagggggaggataggaggggcacaagagataaaaaaccacatattgggtactacatattgggtagagtgacaggtgcgctaaaatctcaggcatcactactatacaattcatctatgtaaccaaaaaccactggtacccccaaaactattgaaattaaaaaatatttttaaaaaagaactatatccacctgtggcagagaaaatggggtatagggtctggacagaaacagacctgcattctccagagaccaagaaagctattaagagagtttaatttggttctatgttagtgtggtgtcaaagcagggtgaatttgcattaaagaagtgtgaaagtctaaaggcaaagtaggtcatgagacacgagaattaaatagggagatatggagactgtttaatgatttaaacctctatcaagcgaattgaacaaagagagactgtttctctgtgtttgcatggtcatggtcattgtgatcactgctcacgttggttgcagcaggctgtcttgccaatggctgctatagcagtaacaggggactggtcagcaaatgtgcattgcatcaatgacatggagcccatgccctttcactggcttgttggtagtggttgcatggggctggggaccccctcttggatctttattgctgacctcacttctctgtatcacacaagtctcaagaagatagagaagacaataatacttaataaaatgagaaaactgttttatcaatatgttaagtgaaaaaagcagaatatgaaactatgtatatgaacctaattggttaaacatatgtgtagaaaaatgactgaaataaaacagattaaaacagtaaataatagttgtctaaggatggaaattacagatgacaatctttcctttatattttatatcttctttgctttcattgataaaaatgttttgcttttgcaattggaaaaggtgaaataaatgtaattaacttataagaaatgtaagttcttccttgttcagagctttacacattgctcagcaacaaatggttgtttgctaattggtatgtaaagggcaataaacaagttaattgctggctacattctcgaatagctagaggaagttcaaagcttctcaaccttatttcagctccaagaaagaggacctctgatgtgggtcaaagacctaatggagtcctcaaaagcccaccatgcgccatagtgggtggaggctgggcaggagggagaagcttcaaagccccctctttccatgacatgcttcttcttcacatcaatttccatcacttccctttccctctctcagctactgttaaaagatggacttttgtattaggttgctggggttgccaaagtaaagtgccacagacttaaatcacagaaatttattttctcaaaattctagggtctagaagtctgagatcgcagtggcagcagggttggtttcttctgagacctctctcctagctggcagatgccctttttcctgtgtcttcacatggtcttccctctctgtgtgtctgggtccgaatctcctcttcttatgaagatatcagtcatattggattagaacccacactaatgacctcatttaacttaaaggctctatctccaaatataggcatttggaaatactgggggttagggccacaatgcataaatttttgggggacacagtttagcctataacaggattgaagtgtctcctttcttaaggagccatgtctctgctcatagagattcaaaagaaagccaaggttgggcttaggagaaaataagcaaaagtagaggctgcttaaagtttttgggtttggtatagcccaccaggttaagaaatctgacaggaatttgagtaatctgaatccattctgcgtttgcccagagtctccttctggacacatagccctcttaaatctctggctgcattgaggctgcttgagaatttgaaatctcagtcatctcctccttggggacatggtgaatatgtcattctgttgaactgatcaccatattatcggatgtttctacaaaagcaaaacagagttgagagcagaaatattagaatcttagaaagtgacaggggctggaggatgaagaggtggcagggtaaaaggatggggtactttggtcatattatccttgataggctggttgacattctcattctctgctaagaacaagcagaagcatcccaggaaactcttatgggactttaatgtgatgaaatgagagagattatctctctcctctgcctaagggatgactatccatagaatgtactcagacttctttccaatcacagagataaatcctgaaagttttgcagtatggtactgatttccttgacctaccagagtccaggtctataaagtttgcctttgcccagccagcagatggtgccatttttctaggaaattgagccagattcagcttgaactgtcatttggcctttagtgttgtaggcactgtgctcacagcatgttgtatagggcttcacaggtaaccagtttctgttcgaggaaagtctagcgctcttacctgcagttgaacacactgaaatcttcaagtttctcagtttaagtgaaaacttttatttttaaaatttcgggataattagaagaaaatcttagtatttcctttagaaaaatcttcccccacccctcaactctctctttctctctctctctctttctcgcatcttattccaacataccaggtggagccatctcatctttcctttgaaaggccctctcacaatccttcacgcttacacatggtgggtggactaaattctatagtgaaattgtagcttttgaggaatgagtacttctgaacagctgctttactttttgggggacatctagctgtgtatttatcttttaaggtataaatgctttccttcaaaaaaatatatacatattctgaaatatttggaagccagttgcagatgttatgacacatcagccctaaatattcagcatataactcctaacaataaagactttcttctatgtaactgctaaaccatgaccatatctaagaaaatcaacagtaatttccaagtattacttaatatccatttcatattcaaaatttcctagttatttcccatatacctttcatagctggttttattcaactgcatccaatcaaagctcacacattacatttagttgtttcatccattcatatatacatatatatgtgtgtgtgtgtgtgtg

SEQ ID NO: 41 - DNA, 601 bp, Homo sapiens
cctgtgcatctaatttagtggggggcagacctgtttcacaagccaaaataacaggctgcaataactgaggattttatatataccctgaccaaagaagtttgcattctcatagcaccatctagtggaaatttggggatttttgttttacatcgaacagcctaaaatggagatagtttatgttattatgacagggagagaagactgcacgatttgctaattgaggtgcaatacagacaagtaaacaaaaacaggaaaaatgtggcttatgtgaaagacattttttaaccatatacaacatgttctataaaaacagagcaaagccgttagctgaggaacttgtgtgcacaaagaaatatgtacaaatagcttttccagaacagtctagtaaaaatatgtagtaaaagtgggaagattatgttatatagaaatatatgtttatgtgctgtgtttatatgccacagcctcaaaccttcttataacttattaacaattatatgaaaatataggaacaaagctcatgttctgtatgaatacaacaggattcaaataaccacatacattacaaagagttgaataaattgaattctctattttctactgt

SEQ ID NO: 42 - DNA, 252 bp, Homo sapiens
attgtggaactgctctttctccctgcgattcagaggggaaaagataaagccacacagccctggggcctcttgcttaagaacacatctcagtttaaccaccaaggccgttatgataacaaatgtcagtatggaggtgtgaacatcaggggctattcaaggacgcttctctgatcactgccatgtctatctgctgtgatcacgactattttataaacacccttcctacccaatgccatcagaattttagggacg

The invention claimed is:

1. A method for the diagnosis and treatment of prostate cancer comprising the steps of a) detecting the expression level of a splice variant of Ensembl gene ID ENSG00000245750.3 selected from the group comprising SEQ ID NO: 4, SEQ ID NO: 5, SEQ ID NO: 6, SEQ ID NO: 7, SEQ ID NO: 8, and SEQ ID NO: 10 in a urine sample collected after digital rectal examination from a patient, wherein the detection is performed using next generation sequencing with a primer or probe that hybridizes under stringent conditions to said target sequence, b) diagnosing the subject as prostate cancer positive when the expression level of said splice variant is at least 2 fold ±20%, c) administering to the subject diagnosed as prostate cancer positive one or more therapeutic agents selected from the group consisting of Docetaxel, Cabazitaxel, Mitoxan-trone, Estramustine, Doxorubicin, etoposide (VP-16), Vinblastine, Paclitaxel, Carboplatin, Abiraterone acetate, Bicalutamide, Casodes, Degarelix, Enzalutamide, Goserelin acetate, Leuprolide acetate, Prednisone, Sipuleucel-T, Radium 223dichloride and Vinorelbine.

2. The method according to claim 1, wherein the next generation sequencing is performed by measuring the fluorescence of a labelled primer, labelled probe or a fluorescent detection agent.

3. The method according to claim 1, wherein the next generation sequencing is performed by qRT-PCR.

* * * * *

UNITED STATES PATENT AND TRADEMARK OFFICE

CERTIFICATE OF CORRECTION

PATENT NO. : 10,196,695 B2
APPLICATION NO. : 15/100943
DATED : February 5, 2019
INVENTOR(S) : Friedemann Horn et al.

It is certified that error appears in the above-identified patent and that said Letters Patent is hereby corrected as shown below:

On the Title Page

Item (73), please replace "Assignee: FRAUNHOFER-GESELLSCHAFT ZUR FÖRDERUNG DER ANGEWANDTEN FORSCHUNG München (CN)" with --FRAUNHOFER-GESELLSCHAFT ZUR FÖRDERUNG DER ANGEWANDTEN FORSCHUNG E.V. München (DE)--

Signed and Sealed this
Thirty-first Day of December, 2019

Andrei Iancu
*Director of the United States Patent and Trademark Office*